US008211634B2

(12) United States Patent
DePinho et al.

(10) Patent No.: US 8,211,634 B2
(45) Date of Patent: Jul. 3, 2012

(54) COMPOSITIONS, KITS, AND METHODS FOR IDENTIFICATION, ASSESSMENT, PREVENTION, AND THERAPY OF CANCER

(75) Inventors: Ronald A. DePinho, Houaton, TX (US); Kenneth C. Anderson, Wellesley, MA (US); Ruben D. Carrasco, Brookline, MA (US); Giovanni Tonon, Cernusco Sul Naviglio (IT); Cameron W. Brennan, Haworth, NJ (US); John D. Shaughnessy, Jr., Roland, AR (US); Lynda Chin, Houston, TX (US)

(73) Assignees: Dana-Farber Cancer Institute, Inc., Boston, MA (US); Board of Trustees of the University of Arkansas, Little Rock, AR (US)

(*) Notice: Subject to any disclaimer, the term of this patent is extended or adjusted under 35 U.S.C. 154(b) by 448 days.

(21) Appl. No.: 11/706,155

(22) Filed: Feb. 13, 2007

(65) Prior Publication Data

US 2008/0075722 A1 Mar. 27, 2008

Related U.S. Application Data

(60) Provisional application No. 60/773,072, filed on Feb. 14, 2006.

(51) Int. Cl.
*C12Q 1/68* (2006.01)
*G01N 33/53* (2006.01)
*G01N 33/574* (2006.01)
(52) U.S. Cl. .................... 435/6; 434/7.1; 434/7.23
(58) Field of Classification Search .................. None
See application file for complete search history.

(56) References Cited

U.S. PATENT DOCUMENTS

| 6,423,491 | B1 | 7/2002 | Howe et al. | |
|---|---|---|---|---|
| 7,189,507 | B2 * | 3/2007 | Mack et al. | 435/6 |
| 2003/0087250 | A1 | 5/2003 | Monahan et al. | |
| 2004/0002082 | A1 | 1/2004 | Feinberg | |
| 2004/0052782 | A1 | 3/2004 | Kikutani et al. | |

FOREIGN PATENT DOCUMENTS

| WO | WO 02/071928 | * | 9/2002 |
| WO | WO 2004/082571 A2 | * | 9/2004 |
| WO | WO-2005/118869 | | 12/2005 |
| WO | WO-2006/089087 | | 8/2006 |

OTHER PUBLICATIONS

Regala et al (Cancer Research, Oct. 2005, 65:8905-8911).*
Tockman et al (Cancer Res., 1992, 52:2711s-2718s).*
Magrangeas et al (Blood, Jun. 2003, 101:4998-5006).*
Zhan et al (Blood, 2002, 99:1745-1757).*
Falini et al (Blood, 2000, 95:2084-2092).*
Abdelhaleem, M., "Do human RNA helicases have a role in cancer?," Biochim Biophys Acta 1704:37-46 (2004).
Aguirre et al., "High-resolution characterization of the pancreatic adenocarcinoma genome," Proc Natl Acad Sci USA 101:9067-9072 (2004).
Armengol et al., "DNA Copy Number Changes and Evaluation of *MYC, IGF1R, and FES* Amplification in Xenografts of Pancreatic Andenocarcinoma," Cancer Genet Cytogenet 116:133-41 (2000).
Avet-Loiseau et al., "Molecular Cytogenetic Abnormalities in Multiple Myeloma and Plasma Cell Leukemia Measured Using Comparative Genomic Hybridization," Genes Chromosomes Cancer 19:124-133 (1997).
Balsara and Testa, "Chromosomal imbalances in human lung cancer," Oncogene 21:6877-6883 (2002).
Bardi et al., "Karyotypic abnormalities in tumours of the pancreas," Br J Cancer 67:1106-1112 (1993).
Barlogie et al., "Thalidomide and Hematopoietic-Cell Transplantation for Multiple Myeloma," N Engl J Med 354:1021-1030 (2006).
Barlogie et al., "Treatment of multiple myeloma," Blood 103, 20-32 (2004).
Bergsagel et al.,"Cyclin D dysregulation: an early and unifying pathogenic event in multiple myeloma," Blood 106:296-303 (2005).
Bergsagel and Kuehl., "Chromosome translocations in multiple myeloma," Oncogene 20:5611-5622 (2001).
Bergsagel and Kuehl, "Molecular Pathogenesis and a Consequent Classification of Multiple Myeloma," J Clin Oncol 23:6333-6338 (2005).
Bjorkqvist et al. "Comparison of DNA copy number changes in malignant mesothelioma, adenocarcinoma and large-cell anaplastic carcinoma of the lung," Br J Cancer 77(2):260-269 (1998).
Brennan et al., "High-Resolution Global Profiling of Genomic Alterations with Long Oligonucleotide Microarray," Cancer Res 64:4744-4748 (2004).
Brummelkamp et al., "Loss of the cylindromatosis tumour suppressor inhibits apoptosis by activating NF-κB," Nature 424:797-801 (2003).
Brunet et al., "Metagenes and molecular pattern discovery using matrix factorization," Proc Natl Acad Sci USA 101:4164-4169 (2004).
Castro et al., "The anaphase-promoting complex: a key factor in the regulation of cell cycle," Oncogene 24:314-325 (2005).
Chang et al., "Analysis of PTEN deletions and mutations in multiple myeloma," Leuk Res 30:262-265 (2006).
Chen, B. H., "Monoclonal gammopathy of undetermined significance: new insights," Can Med Assoc J 166(10):1309 (2002).
Cheng et al., "The RAB25 small GTPase determines aggressiveness of ovarian and breast cancers," Nat Med 10:1251-1256 (2004).
Chng et al., "A validated FISH trisomy index demonstrates the hyperdiploid and nonhyperdiploid dichotomy in MGUS," Blood 106:2156-2161 (2005).
Cigudosa et al., Characterization of Nonrandom Chromosomal Gains and Losses in Multiple Myeloma by Comparative Genomic Hybridization Blood 91:3007-3010 (1998).

(Continued)

*Primary Examiner* — Laura B Goddard
(74) *Attorney, Agent, or Firm* — Foley Hoag LLP

(57) ABSTRACT

The invention relates to compositions, kits, and methods for detecting, characterizing, preventing, and treating human cancer. A variety of chromosomal regions (MCRs) and markers corresponding thereto, are provided, wherein alterations in the copy number of one or more of the MCRs and/or alterations in the amount, structure, and/or activity of one or more of the markers is correlated with the presence of cancer.

16 Claims, 16 Drawing Sheets

OTHER PUBLICATIONS

Colgan et al.,"Cyclophilin A-Deficient Mice Are Resistant to Immunosuppression by Cyclosporine," J Immunol 174:6030-6038 (2005).

Collier et al., "Cancer gene discovery in solid tumours using transposon-based somatic mutagenesis in the mouse," Nature 436, 272-276 (2005).

Cremer et al., "Delineation of Distinct Subgroups of Multiple Myeloma and a Model for Clonal Evolution Based on Interphase Cytogenetics," Genes Chromosomes Cancer 44:194-203 (2005).

Curtis et al., "Amplification of DNA Sequences from Chromosome 19q13.1 in Human Pancreatic Cell Lines," Genomics 53:42-55 (1998).

Dai et al., "The kinase haspin is required for mitotic histone H3 and Thr3 phosphorylation and normal metaphase chromosome alignment," Genes Dev 19:472-488 (2005).

Debes-Marun et al., "Chromosome abnormalities clustering and its implications for pathogenesis and prognosis in myeloma," Leukemia 17:427-436 (2003).

Eder, A.M., "Atypical PKCι contributes to poor prognosis through loss of apical-basal polarity and Cyclin E overexpression in ovarian cancer," Proc Natl Acad Sci U S A.102(35):12519-12524 (2005).

Elnenaei et al., "Delineation of the Minimal Region of Loss at 13q14 in Multiple Myeloma," Genes Chromosomes Cancer 36:99-106 (2003).

Emberley et al., "S100 proteins and their influence on pro-survival pathways in cancer," Biochem Cell Biol 82:508-515 (2004).

Filipits et al., "Low p27$^{Kip1}$ Expression Is an Independent Adverse Prognostic Factor in Patients with Multiple Myeloma," Clin Cancer Res 9:820-826 (2003).

Fonseca et al., "Genetics and Cytogenetics of Multiple Myeloma: A Workshop Report," Cancer Res 64:1546-1558 (2004).

Fujita et al., "Chromosome Arm 20q Gains and Other Genomic Alterations in Esophageal Squamous Cell Carcinoma, as Analyzed by Comparative Genomic Hybridization and Fluorescence in Situ Hybridization," Hepato-Gastroenterology 50, 1857-1863 (2003).

Fukushige et al., "Frequent Gain of Copy Number on the Long Arm of Chromosome 20 in Human Pancreatic Adenocarcinoma," Genes Chromosomes Cancer 19:161-169 (1997).

Furubo et al., "Protein expression and genetic alterations of p53 and ras in intrahepatic cholangiocarcinoma," Histopathology 35:230-240 (1999).

Ghadimi et al., "Specific Chromosomal Aberrations and Amplification of the AIB1 Nuclear Receptor Coactivator Gene in Pancreatic Carcinomas," Am J Pathol 154:525-536 (1999).

Ginzinger, D. M., "Gene quantification using real-time quantitative PCR: An emerging technology hits the mainstream," Exp Hematol 30:503-512 (2002).

Giuliani et al., "Angiogenic Switch in Multiple Myeloma," Hematology 9:377-381 (2004).

Golub et al., "Molecular Classification of Cancer: Class Discovery and Class Prediction by Gene Expression Monitoring," Science 286:531-537 (1999).

Gorunova et al., "Cytogenetic Analysis of Pancreatic Carcinomas: Intratumor Heterogeneity and Nonrandom Pattern of Chromosome Aberrations," Genes Chromosomes Cancer 23:81-99 (1998).

Gorunova et al., "Massive Cytogenetic Heterogeneity in a Pancreatic Carcinoma: Fifty-Four Karyotypically Unrelated Clones," Genes Chromosomes Cancer 14:259-266 (1995).

Griffin et al., "Chromosome Abnormalities in Pancreatic Adenocarcinoma," Genes Chromosomes Cancer 9:93-100 (1994).

Griffin et al., "Consistent Chromosome Abnormalities in Adenocarcinoma of the Pancreas," Cancer Res 55:2394-2399 (1995).

Grunicke et al., "Regulation of cell survival by atypical protein kinase C isozymes," Advan. Enzyme Regul. 43:213-228 (2003).

Hahn et al., "Allelotype of Pancreatic Adenocarcinoma Using Xenograft Enrichment," Cancer Res 55:4670-4675 (1995).

Harrington et al., "The Identification and Characterization of a G4-DNA Resolvase Activity," J Biol Chem 272(39):24631-24636 (1997).

He et al., "A microRNA polycistron as a potential human oncogene," Nature 435:828-833 (2005).

Hideshima et al., "Advances in biology of multiple myeloma: clinical applications," Blood 104(3):607-618 (2004).

Hyman et al., "Impact of DNA Amplification on Gene Expression Patterns in Breast Cancer," Cancer Res 62, 6240-6245 (2002).

Isler et al., "Evidence for transcriptional repression of SPARC-like 1, a gene downregulated in human lung tumors," Int J Oncol 25:1073-1079 (2004).

Johansson et al., "Nonrandom Chromosomal Rearrangements in Pancreatic Carcinomas," Cancer 69:1674-1681 (1992).

Kanamori et al., "The PDZ Protein Tax-interacting Protein-1 Inhibits β-Catenin Transcriptional Activity and Growth of Colorectal Cancer Cells," J Biol Chem 278:38758-38764 (2003).

Katoh, M., "Molecular cloning and characterization of ST7R (ST7-like, ST7L) on human chromosome 1p13, a novel gene homologous to tumor suppressor gene ST7 on human chromosome 7q31," Int J Oncol 20:1247-1253 (2002).

Kawasaki et al., "11q23-24 loss is associated with chromosomal instability in endometrial cancer," Int J Mol Med 12(5):727-731 (2003).

Kikutani and Kumanogoh, "Semaphorins in interactions between T cells and antigen-presenting cells," Nat Rev Immunol 3:159-167 (2003).

Kim et al.,"Cyclophilin A as a Novel Biphasic Mediator of Endothelial Activation and Dysfunction," Am J Pathol 164:1567-1574 (2004).

Kimura et al., "Detailed Deletion Mapping on Chromosome Arm 12q in Human Pancreatic Adenocarcinoma: Identification of a 1-cM Region of Common Allelic Loss," Genes Chromosomes Cancer 17:88-93 (1996).

Kimura et al., "Genetic alterations in 102 primary gastric cancers by comparative genomic hybridization: gain of 20q and loss of 18q are associated with tumor progression," Mod Pathol, 17:1328-1337 (2004).

Kuehl and Bergsagel, "Multiple Myeloma: Evolving Genetic Events and Host Interactions," Nat Rev Cancer 2:175-187 (2002).

Kumanogoh et al., "Class IV semaphorin Sema4A enhances T-cell activation and interacts with Tim-2," Nature 419:629-633 (2002).

Kyle and Rajkumar, "Multiple Myeloma," N Engl J Med 351:1860-1873 (2004).

Lakhani, S. R., "Putting the Brakes on Cylindromatosis?," N Engl J Med 350:187-188 (2004).

Lindsey et al., "Epigenetic inactivation of MCJ (DNAJD1) in malignant pediatric brain tumours," Int J Cancer, 118:346-352 (2006).

Lucito et al., "Representational Oligonucleotide Microarray Analysis: A High-Resolution Method to Detect Genome Copy Number Variation," Genome Res 13:2291-2305 (2003).

Luk et al., "Molecular cytogenetic analysis of non-small cell lung carcinoma by spectral karyotyping and comparative genomic hybridization," Cancer Genet Cytogenet 125:87-99 (2001).

Magrassi et al., "Shc3 affects human high-grade astrocytomas survival," Oncogene 24:5198-5206 (2005).

Mahlamaki et al., "Comparative genomic hybridization reveals frequent gains of 20q, 8q, 11q, 12p, and 17q, and losses of 18q, 9p, and 15q in pancreatic cancer," Genes Chromosomes Cancer 20:383-391 (1997).

Mahlamaki et al., "Frequent amplification of 8q24, 11q, 17q and 20q-specific genes in pancreatic cancer," Genes Chromosomes Cancer 35:353-358 (2002).

Maina et al., "Identification of novel VHL target genes and relationship to hypoxic response pathways," Oncogene 24:4549-4558 (2005).

Matsuda et al. "Large-scale identification and characterization of human genes that activate NF-kappaB and MAPK signaling pathways," Oncogene 22:3307-3318 (2003).

Medema et al., "AFX-like Forkhead transcription factors mediate cell-cycle regulation by Ras and PKB through p27$^{kip1}$," Nature 404:782-786 (2000).

Mitsiades et al., "Focus on multiple myeloma," Cancer Cell 6:439-444 (2004).

Monti et al., "Molecular profiling of diffuse large B-cell lymphoma identifies robust subtypes including one characterized by host inflammatory response," Blood 105:1851-1861 (2005).

Mootha et al., "PGC-1α-responsive genes involved in oxidative phosphorylation are coordinately downregulated in human diabetes," Nat Genet 34:267-273 (2003).

Murray et al., "Protein kinase Cι is required for Ras transformation and colon carcinogenesis in vivo," J Cell Biol 164(6):797-802 (2004).

Nakayama and Nakayama, "Regulation of the cell cycle by SCF-type ubiquitin ligases," Semin Cell Dev Biol 16:323-333 (2005).

Nilsson et al., "Amplification of Chromosome 1 Sequences in Lipomatous Tumors and Other Sarcomas," Int J Cancer 109:363-369 (2004).

Olshen et al., "Circular binary segmentation for the analysis of array-based DNA copy number data," Biostatistics 5:557-572 (2004).

Olshen and Venkatraman, "Change-Point Analysis of Array-Based Comparative Genomic Hybridization Data," ASA Proc Joint Stat Meetings 2530-2535 (2002).

Panani et al., "Cytogenetic Data as a Prognostic Factor in Multiple Myeloma Patients: Involvement of 1p12 Region an Adverse Prognostic Factor," Anticancer Res 24:4141-4146 (2004).

Pei et al., "Genomic Imbalances in Human Lung Adenocarcinomas and Squamous Cell Carcinomas," Genes Chromosomes Cancer 31:282-287 (2001).

Perez-Andres et al. "Interaction between clonal plasma cells and the immune system in plasma cell dyscrasias," J Biol Regul Homeost Agents 18:161-165 (2004).

Petersen et al., "Patterns of Chromosomal Imbalances in Adenocarcinoma and Squamous Cell Carcinoma of the Lung," Cancer Res 57:2331-2335 (1997).

Pinkel et al., "High resolution analysis of DNA copy number variation using comparative genomic hybridization to microarrays," Nat Genet 20:207-211 (1998).

Platzer et al., "Silence of Chromosomal Amplifications in Colon Cancer," Cancer Res 62:1134-1138 (2002).

Pollack et al.,"Microarray analysis reveals a major direct role of DNA copy number alteration in the transcriptional program of human breast tumors," Proc Natl Acad Sci USA 99:12963-12968 (2002).

Protopopov et al., "Human chromosome 3: high-resolution fluorescence in situ hybridization mapping of 40 unique NotI linking clones homologous to genes and cDNAs," Chromosome Res 4:443-447 (1996).

Pullikuth et al., "The MEK1 Scaffolding Protein MP1 Regulates Cell Spreading by Integrating PAK1 and Rho Signals," Mol Cell Biol 25:5119-5133 (2005).

Qiang et al., "Wnts induce migration and invasion of myeloma plasma cells," Blood 106:1786-1793 (2005).

Rajkumar and Kyle, "Multiple Myeloma: Diagnosis and Treatment," Mayo Clin Proc 80:1371-1382 (2005).

Regala et al., "Atypical Protein Kinase Cι Plays a Critical Role in Human Lung Cancer Cell Growth and Tumorigenicity," J Biol Chem 280(35):31109-31115 (2005).

Richardson et al., "Novel biological therapies for the treatment of multiple myeloma," Best Pract Res Clin Haematol 18:619-634 (2005).

Sawyer et al., "Identification of New Nonrandom Translocations in Multiple Myeloma With Multicolor Spectral Karyotyping," Blood 92:4269-4278 (1998).

Sebat et al., "Large-Scale Copy Number Polymorphism in the Human Genome," Science 305:525-528 (2004).

Seymour et al., "Allelotype of Pancreatic Adenocarcinoma," Cancer Res 54:2761-2764 (1994).

Shaughnessy, Jr. and Barlogie, "Interpreting the molecular biology and clinical behavior of multiple myeloma in the context of global gene expression profiling," Immunol Rev 194:140-163 (2003).

Smith et al., "A Transcript Map of the Chromosome 19q-Arm Glioma Tumor Suppressor Region," Genomics 64:44-50 (2000).

Solinas-Toldo et al., "Mapping of Chromosomal Imbalances in Pancreatic Carcinoma by Comparative Genomic Hybridization," Cancer Res 56:3803-3807 (1996).

Stepanova et al., "Induction of human Cdc37 in prostate cancer correlates with the ability of targeted Cdc37 expression to promote prostatic hyperplasia," Oncogene 19:2186-2193 (2000).

Stepanova et al., "The Oncoprotein Kinase Chaperone $CDC37$ Functions as an Oncogene in Mice and Collaborates with Both c-$myc$ and Cyclin D1 in Transformation of Multiple Tissues," Mol Cell Biol 20(12):4462-4472 (2000).

Stewart et al., "Lentivirus-delivered stable gene silencing by RNAi in primary cells," RNA 9:493-501 (2003).

Titus et al., "Rho Proteins in Cell Migration and Metastasis," Crit Rev Eukaryot Gene Expr, 15:103-114 (2005).

Tonon et al., "High-resolution genomic profiles of human lung cancer," Proc Natl Acad Sci USA 102:9625-9630 (2005).

Tusher et al., "Significance analysis of microarrays applied to the ionizing radiation response," Proc Natl Acad Sci USA 98:5116-5121 (2001).

Urashima et al., "Characterization of p16$^{INK4A}$ Expression in Multiple Myeloma and Plasma Cell Leukemia," Clin Cancer Res 3:2173-2179 (1997).

van Duin et al., "Construction and Application of a Full-Coverage, High-Resolution, Human Chromosome 8q Genomic Microarray for Comparative Genomic Hybridization," Cytometry Part A 63A:10-19 (2005).

van Everdink et al.,"$RFP2$, $c13ORF1$, and $FAM10A4$ are the most likely tumor suppressor gene candidates for B-cell chronic lymphocytic leukemia," Cancer Genet Cytogenet 146:48-57 (2003).

Vaughn et al., "The DEXH Protein Product of the DHX36 Gene Is the Major Source of Tetramolecular Quadruplex G4-DNA Resolving Activity in HeLa Cell Lysates," J Biol Chem, 280(46):38117-38120 (2005).

Wang et al., "Loss of Heterozygosity and Its Correlation with Expression Profiles in Subclasses of Invasive Breast Cancers," Cancer Res 64:64-71 (2004).

Wolf et al., "High-Resolution Analysis of Gene Copy Number Alterations in Human Prostate Cancer Using CGH on cDNA Microarrays: Impact of Copy Number on Gene Expression," Neoplasia 6(3):240-247 (2004).

Wullich et al., "Evidence for gains at 15q and 20q in brain metastases of prostate cancer," Cancer Genet Cytogenet 154:119-123 (2004).

Zhan et al., "Gene expression profiling of human plasma cell differentiation and classification of multiple myeloma based on similarities to distinct stages of late-stage B-cell development," Blood 101:1128-1140 (2003).

Larramendyac, M., et al., "Comparative Genomic Hybridization Reveals Differences in DNA Copy Number Changes between Sporadic Gastric Carcinomas and Gastric Carcinomas from Patients with Hereditary Nonpolyposis Colorectal Cancer", Cancer Genetics and Cytogenetics, vol. 106, pp. 62-65 (1998) (Abstract Only).

Zhao, X., et al, an Integrated View of Copy Number and Allelic Alterations in the Cancer Genome Using Single Nucleotide Polymorphism Arrays, Cancer Research, vol. 64, pp. 3060-3071 (2004).

International Search Report dated Aug. 6, 2008 from PCT/US07/03697.

Wu et al., "Somatic mutation and gain of copy number of PIK3CA in human breast cancer," Breast Cancer Research, 7(5):R609-R616 (2005).

Supplementary European Search Report dated Feb. 17, 2010 from EP 07 75 0528.

* cited by examiner

COMPOSITIONS, KITS, AND METHODS FOR IDENTIFICATION, ASSESSMENT, PREVENTION, AND THERAPY OF CANCER

RELATED APPLICATIONS

This application claims the benefit of U.S. Provisional Application Ser. No. 60/773,072, filed on Feb. 14, 2006; the entire contents of the application is incorporated herein by reference.

GOVERNMENT FUNDING

Work described herein was supported, at least in part, by National Institutes of Health (NIH) under grant RO1 CA99041, R01 CA86379, R01CA84628, K08 AG01031-02, and T32 CA09382. The government may therefore have certain rights to this invention.

SEQUENCE LISTING

The instant application was filed with sequences corresponding to SEQ ID NOs:1-713 on Feb. 13, 2007 and these sequences were submitted in paper and electronic form on Nov. 9, 2007 in a formal Sequence Listing. The formal Sequence Listing is hereby incorporated by reference in its entirety.

BACKGROUND OF THE INVENTION

Cancer represents the phenotypic end-point of multiple genetic lesions that endow cells with a full range of biological properties required for tumorigenesis. Indeed, a hallmark genomic feature of many cancers, including, for example, B cell cancer, lung cancer, breast cancer, ovarian cancer, pancreatic cancer, and colon cancer, is the presence of numerous complex chromosome structural aberrations—including non-reciprocal translocations, amplifications and deletions.

Karyotype analyses (Johansson, B., et al. (1992) Cancer 69, 1674-81; Bardi, G., et al. (1993) Br J Cancer 67, 1106-12; Griffin, C. A., et al. (1994) Genes Chromosomes Cancer 9, 93-100; Griffin, C. A., et al. (1995) Cancer Res 55, 2394-9; Gorunova, L., et al. (1995) Genes Chromosomes Cancer 14, 259-66; Gorunova, L., et al. (1998) Genes Chromosomes Cancer 23, 81-99), chromosomal CGH and array CGH (Wolf M et al. (2004) Neoplasia 6(3)240; Kimura Y, et al. (2004) Mod. Pathol. 21 May (epub); Pinkel, et al. (1998) Nature Genetics 20:211; Solinas-Toldo, S., et al. (1996) Cancer Res 56, 3803-7; Mahlamaki, E. H., et al. (1997) Genes Chromosomes Cancer 20, 383-91; Mahlamaki, E. H., et al. (2002) Genes Chromosomes Cancer 35, 353-8; Fukushige, S., et al. (1997) Genes Chromosomes Cancer 19:161-9; Curtis, L. J., et al. (1998) Genomics 53, 42-55; Ghadimi, B. M., et al. (1999) Am J Pathol 154, 525-36; Armengol, G., et al. (2000) Cancer Genet Cytogenet 116, 133-41), fluorescence in situ hybridization (FISH) analysis (Nilsson M et al. (2004) Int J Cancer 109(3):363-9; Kawasaki K et al. (2003) Int J Mol. Med. 12(5):727-31) and loss of heterozygosity (LOH) mapping (Wang Z C et al. (2004) Cancer Res 64(1):64-71; Seymour, A. B., et al. (1994) Cancer Res 54, 2761-4; Hahn, S. A., et al. (1995) Cancer Res 55, 4670-5; Kimura, M., et al. (1996) Genes Chromosomes Cancer 17, 88-93) have identified recurrent regions of copy number change or allelic loss in various cancers.

Multiple Myeloma (MM) is characterized by clonal proliferation of abnormal plasma cells in the bone marrow, usually with elevated serum and urine monoclonal paraprotein levels and associated end-organ sequelae. MM accounts for more than 10% of all hematological malignancies and is the second most frequent hematological cancer in the US after non-Hodgkin lymphoma. MM is typically preceded by an age-progressive condition termed Monoclonal Gammopathy of Undetermined Significance (MGUS), a condition present in 1% of adults over age of 25 that progresses to malignant MM at a rate of 0.5-3% per year (Kyle, R. A., and Rajkumar, S. V. (2004) N Engl J Med 351, 1860-1873; Mitsiades et al. (2004) Cancer Cell 6, 439-444; Bergsagel et al. (2005) Blood 106, 296-303). MM remains incurable despite high-dose chemotherapy with stem cell support. Novel agents such as thalidomide, the immunoregulator Revlimid, and the proteasome inhibitor bortezomid can achieve responses in patients with relapsed and refractory MM, however, the median survival remains at 6 years with only 10% of the patients surviving at 10 years (Barlogie et al. (2004) Blood 103, 20-32; Richardson et al. (2005) Best Pract Res Clin Haematol 18, 619-634; Rajkumar, S. V., and Kyle, R. A. (2005) Mayo Clin Proc 80, 1371-1382).

Significant effort has been directed towards the identification of the molecular genetic events leading to this malignancy with the goals of improving early detection and providing new therapeutic targets. Unlike most hematological malignancies and more similar to solid tissue neoplasms, MM genomes are typified by numerous structural and numerical chromosomal aberrations (Kuehl, W. M., and Bergsagel, P. L. (2002) Nat Rev Cancer 2, 175-187). Reflecting the increasing genomic instability that characterizes disease progression, metaphase chromosomal abnormalities can be detected in only one-third of newly diagnosed patients but are evident in the majority of patients with end-stage disease (Fonseca et al. (2004) Cancer Res 64, 1546-1558). Yet, applying DNA content or interphase fluorescence in situ hybridization (FISH) analyses, aneuploidy and translocations are detectable in virtually all subjects with MM and even MGUS (Chng et al. (2005) Blood 106, 2156-2161; Bergsagel, P. L., and Kuehl, W. M. (2001) Oncogene 20, 5611-5622). Extensive molecular (Kuehl, W. M., and Bergsagel, P. L. (2002) Nat Rev Cancer 2, 175-187; Shaughnessy, J. D., Jr., and Barlogie, B. (2003) Immunol Rev 194, 140-163), cytogenetic (Bergsagel, P. L., and Kuehl, W. M. (2001) Oncogene 20, 5611-5622; Sawyer et al. (1998) Blood 92, 4269-4278; Debes-Marun et al., (2003) Leukemia 17, 427-436), chromosomal CGH (Avet-Loiseau et al. (1997) Genes Chromosomes Cancer 19, 124-133; Cigudosa et al. (1998) Blood 91, 3007-3010), analyses have uncovered a number of recurrent genetic alterations in MM and its precursor MGUS, some of which have been linked to disease pathogenesis and clinical behavior.

Chromosomal translocations involving the IgH locus at 14q32 and various partner loci are seen in most MM cell lines, consistent with MM's origin from antigen-driven B cells in post-germinal centers (Kuehl, W. M., and Bergsagel, P. L. (2002) Nat Rev Cancer 2, 175-187). Five recurrent loci/genes are commonly juxtaposed to the powerful IG enhancer locus elements, including 11q13 (CCND1), 4p 16 (FGFR3/WHSC1), 6p21 (CCND3), 16q23 (MAF) and 20q11 (MAFB), resulting in deregulated expression of these target genes in neoplastic plasma cells (Bergsagel, P. L., and Kuehl, W. M. (2005) J Clin Oncol 23, 6333-6338). Such translocations, present in MGUS, are considered central to the genesis of MM, whereas disease progression is associated with mutational activation of NRAS or KRAS oncogenes and inactivation of CDKN2A, CDKN2C, CDKN1B and/or PTEN tumor suppressor genes. Late mutational events involve inactivation of TP53 and secondary translocations that activate MYC (Kuehl, W. M., and Bergsagel, P. L. (2002) Nat Rev Cancer 2, 175-187).

Two oncogenic pathways have been hypothesized for the pathogenesis of MGUS/MM. Hyperdiploid MM involves multiple trisomies of chromosomes 3, 5, 7, 9, 11, 15, 19, and 21, whereas the non-hyperdiploid pathway is associated with a prevalence of IgH translocations (Bergsagel et al. (2005) Blood 106, 296-303; Fonseca et al. (2004) Cancer Res 64, 1546-1558; Cremer et al. (2005) Genes Chromosomes Cancer 44, 194-203). Ploidy level also impacts prognosis: non-hyperdiploidy imparts short survival (Fonseca et al. (2004) Cancer Res 64, 1546-1558) that can be counteracted by the presence of trisomies involving chromosomes 6, 9, 11, and 17. Complete or partial deletion of chromosome 13, especially band 13q14, is commonly observed in non-hyperdiploid MM and confers high risk (Fonseca et al. (2004) Cancer Res 64, 1546-1558). Employing gene expression profiling, there have been efforts in trying to define molecular subgroups of MM with clinical correlates and a novel TC classification (translocation/cyclin D) of MM has been proposed (Bergsagel et al. (2005) Blood 106, 296-303). A recent analysis of gene expression profiles of 511 outcome-annotated MM cases has pointed to amplification at 1q21 as an independent predictor of outcome. While these antecedent efforts have led to important insights into the pathogenesis and clinical behavior of MM, the presence of so many recurrent genomic alterations points to the existence of many undefined genetic elements which may prove relevant to disease initiation, progression and maintenance, as well as drug responsiveness. Specifically, while recurrent chromosomal gains have been mapped to 1q, 3q, 9q, 11q, 12q, 15q, 17q, and 22q and recurrent losses to 6q, 13q, 16q, Xp, and Xq, the presumed cancer-relevant targets in these loci are not yet known. Thus, the discovery of these new myeloma-relevant genes is likely to provide improved classification systems that will guide clinical management and identify new oncogenes and therapeutic targets.

SUMMARY OF THE INVENTION

The present invention is based, at least in part, on the identification of specific regions of the genome (referred to herein as minimal common regions (MCRs)), of recurrent copy number change which are contained within certain chromosomal regions (loci) and are associated with cancer. These MCRs were identified using a cDNA or oligomer-based platform and bioinformatics tools which allowed for the high-resolution characterization of copy-number alterations in the B cell cancer genome (see Example 1). The present invention is based, also in part, on the identification of markers residing within the MCRs of the invention, which are also associated with cancer. For example, and without limitation, four markers in MM have been identified namely, SEMA4A, PRKCi, DHX36 and GPR89, by utilizing the materials and methods described herein (see Example 2).

Accordingly, in one aspect, the present invention provides methods of assessing whether a subject is afflicted with cancer or at risk for developing cancer, comprising comparing the copy number of an MCR in a subject sample to the normal copy number of the MCR, wherein the MCR is selected from the group consisting of the MCRs listed in Tables 1 or 2, and wherein an altered copy number of the MCR in the sample indicates that the subject is afflicted with cancer or at risk for developing cancer. In one embodiment, the copy number is assessed by fluorescent in situ hybridization (FISH). In another embodiment, the copy number is assessed by quantitative PCR (qPCR). In yet another embodiment, the copy number is assessed by FISH plus spectral karotype (SKY). In still another embodiment, the normal copy number is obtained from a control sample. In yet another embodiment, the sample is selected from the group consisting of tissue, whole blood, serum, plasma, buccal scrape, saliva, cerebrospinal fluid, urine, stool, and bone marrow.

In another aspect, the invention provides methods of assessing whether a subject is afflicted with cancer or at risk for developing cancer comprising comparing the amount, structure, and/or activity of a marker in a subject sample, wherein the marker is a marker which resides in an MCR listed in Tables 1 or 2, and the normal amount, structure, and/or activity of the marker, wherein a significant difference between the amount, structure, and/or activity of the marker in the sample and the normal amount, structure, and/or activity is an indication that the subject is afflicted with cancer or at risk for developing cancer. In one embodiment, the marker is selected from the group consisting of the markers listed in Tables 4 or 5. In another embodiment, the amount of the marker is determined by determining the level of expression of the marker. In yet another embodiment, the level of expression of the marker in the sample is assessed by detecting the presence in the sample of a protein corresponding to the marker. The presence of the protein may be detected using a reagent which specifically binds with the protein. In one embodiment, the reagent is selected from the group consisting of an antibody, an antibody derivative, and an antibody fragment. In another embodiment, the level of expression of the marker in the sample is assessed by detecting the presence in the sample of a transcribed polynucleotide or portion thereof, wherein the transcribed polynucleotide comprises the marker. In one embodiment, the transcribed polynucleotide is an mRNA or cDNA. The level of expression of the marker in the sample may also be assessed by detecting the presence in the sample of a transcribed polynucleotide which anneals with the marker or anneals with a portion of a polynucleotide wherein the polynucleotide comprises the marker, under stringent hybridization conditions.

In another embodiment, the amount of the marker is determined by determining copy number of the marker. The copy number of the MCRs or markers may be assessed by comparative genomic hybridization (CGH), e.g., array CGH. In still another embodiment, the normal amount, structure, and/or activity is obtained from a control sample. In yet another embodiment, the sample is selected from the group consisting of tissue, whole blood, serum, plasma, buccal scrape, saliva, cerebrospinal fluid, urine, stool, and bone marrow.

In another aspect, the invention provides methods for monitoring the progression of cancer in a subject comprising a) detecting in a subject sample at a first point in time, the amount and/or activity of a marker, wherein the marker is a marker which resides in an MCR listed in Tables 1 or 2; b) repeating step a) at a subsequent point in time; and c) comparing the amount and/or activity detected in steps a) and b), and therefrom monitoring the progression of cancer in the subject. In one embodiment, the marker is selected from the group consisting of the markers listed in Tables 4 or 5. In another embodiment, the sample is selected from the group consisting of tissue, whole blood, serum, plasma, buccal scrape, saliva, cerebrospinal fluid, urine, stool, and bone marrow. In still another embodiment, the sample comprises cells obtained from the subject. In yet another embodiment, between the first point in time and the subsequent point in time, the subject has undergone treatment for cancer, has completed treatment for cancer, and/or is in remission.

In still another aspect, the invention provides methods of assessing the efficacy of a test compound for inhibiting cancer in a subject comprising comparing the amount and/or activity of a marker in a first sample obtained from the subject and maintained in the presence of the test compound, wherein the marker is a marker which resides in an MCR listed in Tables 1 or 2, and the amount and/or activity of the marker in a second sample obtained from the subject and maintained in the absence of the test compound, wherein a significantly higher amount and/or activity of a marker in the first sample which is deleted in cancer, relative to the second sample, is an indication that the test compound is efficacious for inhibiting cancer, and wherein a significantly lower amount and/or activity of the marker in the first sample which is amplified in cancer, relative to the second sample, is an indication that the test compound is efficacious for inhibiting cancer in the subject. In one embodiment, the first and second samples are portions of a single sample obtained from the subject. In another embodiment, the first and second samples are portions of pooled samples obtained from the subject. In one embodiment, the marker is selected from the group consisting of the markers listed in Tables 4 or 5.

In yet another aspect, the invention provides methods of assessing the efficacy of a therapy for inhibiting cancer in a subject comprising comparing the amount and/or activity of a marker in the first sample obtained from the subject prior to providing at least a portion of the therapy to the subject, wherein the marker is a marker which resides in an MCR listed in Tables 1 or 2, and the amount and/or activity of the marker in a second sample obtained from the subject following provision of the portion of the therapy, wherein a significantly higher amount and/or activity of a marker in the first sample which is deleted in cancer, relative to the second sample, is an indication that the test compound is efficacious for inhibiting cancer and wherein a significantly lower amount and/or activity of a marker in the first sample which is amplified in cancer, relative to the second sample, is an indication that the therapy is efficacious for inhibiting cancer in the subject. In one embodiment, the marker is selected from the group consisting of the markers listed in Tables 4 or 5.

Another aspect of the invention provides methods of selecting a composition capable of modulating cancer comprising obtaining a sample comprising cancer cells; contacting said cells with a test compound; and determining the ability of the test compound to modulate the amount and/or activity of a marker, wherein the marker is a marker which resides in an MCR listed in Tables 1 or 2, thereby identifying a modulator of cancer. In one embodiment, the marker is selected from the group consisting of the markers listed in Tables 4 or 5. The cells may be isolated from, e.g., an animal model of cancer, a cancer cell line, e.g., a B cell cancer cell line originating from a B cell tumor, or from a subject suffering from cancer.

Yet another aspect of the invention provides methods of selecting a composition capable of modulating cancer comprising contacting a marker with a test compound; and determining the ability of the test compound to modulate the amount and/or activity of a marker, wherein the marker is a marker which resides in an MCR listed in Tables 1 or 2, thereby identifying a composition capable of modulating cancer. In one embodiment, the marker is selected from the group consisting of the markers listed in Tables 4 or 5. In another embodiment, the method further comprises administering the test compound to an animal model of cancer. In still another embodiment, the modulator inhibits the amount and/or activity of a gene or protein corresponding to a marker set forth in Tables 1 or 4 which is amplified, e.g., a marker selected from the markers listed in Tables 1 or 4. In yet another embodiment, the modulator increases the amount and/or activity of a gene or protein corresponding to a marker set forth in Tables 2 or 5 which is deleted, e.g., a marker selected from the markers listed in Tables 2 or 5.

In another aspect, the invention provides kits for assessing the ability of a compound to inhibit cancer comprising a reagent for assessing the amount, structure, and/or activity of a marker, wherein the marker is a marker which resides in an MCR listed in Tables 1 or 2. In one embodiment, the marker is selected from the group consisting of the markers listed in Tables 4 or 5.

The invention also provides kits for assessing whether a subject is afflicted with cancer comprising a reagent for assessing the copy number of an MCR selected from the group consisting of the MCRs listed in Tables 1 or 2, as well as kits for assessing whether a subject is afflicted with cancer, the kit comprising a reagent for assessing the amount, structure, and/or activity of a marker. In one embodiment, the marker is selected from the group consisting of the markers listed in Table 4 or 5.

In another aspect, the invention provides kits for assessing the presence of human cancer cells comprising an antibody or fragment thereof, wherein the antibody or fragment thereof specifically binds with a protein corresponding to a marker, wherein the marker is a marker which resides in an MCR listed in Tables 1 or 2. In one embodiment, the marker is selected from the group consisting of the markers listed in Tables 4 or 5.

In still another aspect, the invention provides kits for assessing the presence of cancer cells comprising a nucleic acid probe wherein the probe specifically binds with a transcribed polynucleotide corresponding to a marker, wherein the marker is a marker which resides in an MCR listed in Tables 1 or 2. In one embodiment, the marker is selected from the group consisting of the markers listed in Tables 4 or 5.

In yet another aspect, the invention provides methods of treating a subject afflicted with cancer comprising administering to the subject a modulator of the amount and/or activity of a gene or protein corresponding to a marker, wherein the marker is a marker which resides in an MCR listed in Tables 1 or 2. In one embodiment, the marker is selected from the group consisting of the markers listed in Tables 4 or 5.

The invention also provides methods of treating a subject afflicted with cancer comprising administering to the subject a compound which inhibits the amount and/or activity of a gene or protein corresponding to a marker which resides in an MCR listed in Tables 1 or 4 which is amplified in cancer, e.g., a marker selected from the markers listed in Tables 1 or 4, thereby treating a subject afflicted with cancer. In one embodiment, the compound is administered in a pharmaceutically acceptable formulation. In another embodiment, the compound is an antibody or an antigen binding fragment thereof, which specifically binds to a protein corresponding to the marker. For example, the antibody may be conjugated to a toxin or a chemotherapeutic agent. In still another embodiment, the compound is an RNA interfering agent, e.g., an siRNA molecule or an shRNA molecule, which inhibits expression of a gene corresponding to the marker. In yet another embodiment, the compound is an antisense oligonucleotide complementary to a gene corresponding to the marker. In still another embodiment, the compound is a peptide or peptidomimetic, a small molecule which inhibits activity of the marker, e.g., a small molecule which inhibits a protein-protein interaction between a marker and a target protein, or an aptamer which inhibits expression or activity of the marker.

In another aspect, the invention provides methods of treating a subject afflicted with cancer comprising administering to the subject a compound which increases expression or activity of a gene or protein corresponding to a marker which resides in an MCR listed in Tables 2 or 5 which is deleted in cancer, e.g., a marker selected from the markers listed in Tables 2 or 5, thereby treating a subject afflicted with cancer. In one embodiment, the compound is a small molecule.

The invention also includes methods of treating a subject afflicted with cancer comprising administering to the subject a protein corresponding to a marker, e.g., a marker selected from the markers listed in Tables 1, 2, 4 or 5, thereby treating a subject afflicted with cancer. In one embodiment, the protein is provided to the cells of the subject, by a vector comprising a polynucleotide encoding the protein. In still another embodiment, the compound is administered in a pharmaceutically acceptable formulation.

The present invention also provides isolated proteins, or fragments thereof, corresponding to a marker selected from the markers listed in Tables 1, 2, 4 or 5.

In another aspect, the invention provides isolated nucleic acid molecules, or fragments thereof, corresponding to a marker selected from the markers listed in Tables 1, 2, 4 or 5.

In still another aspect, the invention provides isolated antibodies, or fragments thereof, which specifically bind to a protein corresponding to a marker selected from the markers listed in Tables 1, 2, 4 or 5.

In yet another aspect, the invention provides an isolated nucleic acid molecule, or fragment thereof, contained within an MCR selected from the MCRs listed in Table Tables 1 or 2, wherein said nucleic acid molecule has an altered amount, structure, and/or activity in cancer. The invention also provides an isolated polypeptide encoded by the nucleic acid molecules.

BRIEF DESCRIPTION OF THE DRAWINGS

FIG. 15B further depicts that PRKCi and SEMA4AshRNA exhibit anchorage independent growth of OFM1 cells (MM origins) in soft agar. FIG. 15A illustrates density, size and number of the colonies formed in soft agar, while FIG. 15B is a digital representation of the colony numbers per plate. Two effective shRNA1 and 5 were used against both PRKCi and SEMA4A.

BRIEF DESCRIPTION OF THE TABLES

Figure 7:
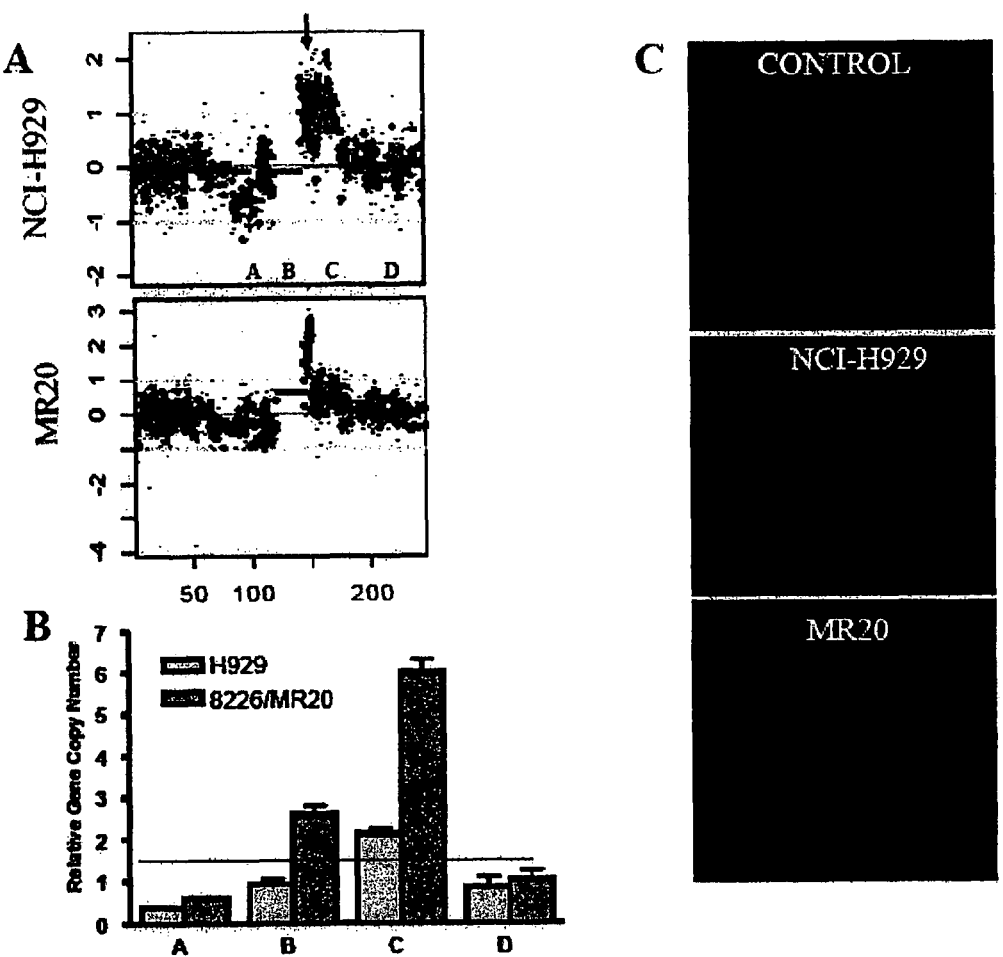
FIGS. 7A-C depict QPCR and FISH verification of 1q21 amplification. Chromosome 1 array-CGH profile (A) for a CNA in the NCI-H929 and MR20 cell lines containing a 1q amplification (the arrow indicates the position of BCL9) as confirmed by QPCR analysis (B) using specific set of probes flanking the A, B, C and D genomic intervals and FISH analysis (C) using a BAC probe including BCL9 (labeled in red).

Table 1 shows high-confidence MCRs in Multiple Myeloma: Gains and Amplifications. For each MCR, the number of NCBI known genes is reported. Number of transcripts is based on Build 35 of the National Center for Biotechnology Information. Within the amplified MCR, some of the genes showing both copy number-driven expression and overexpression also in the absence of amplification (see Materials and Methods) are reported (candidate genes). In bold face MCRs validated by QPCR and/or FISH, Black diamonds identify MCRs associated with poor survival (PS-MCRs). MCR recurrence is denoted as percentage of the total dataset. Only the known genes within the boundaries have been included. Known hotspots for proviral integration residing within MCRs and MCR containing microRNAs are indicated. The MCR in 1q was subjected to further fine mapping (FIG. 7).

Table 2 shows high-confidence MCRs in Multiple Myeloma: Losses and Deletions. For each MCR, the number of NCBI known genes is reported. Number of transcripts is based on Build 35 of the National Center for Biotechnology Information. In bold face MCRs validated by QPCR and/or FISH, Black diamonds identify MCRs associated with poor survival (PS-MCRs). Potential tumor suppressor genes residing within the MCRs are indicated. Known hotspots for proviral integration residing within MCRs and MCR containing microRNAs are indicated. The MCR at 11q11 has recently been shown by Sebat et al. (Sebat et al., 2004) to be a copy number polymorphism (ORF511, chromosome 11q11).

Table 3 is a list of CD138 purified primary tumor cells subjected to aCGH and expression profiling analysis. Clinical outcome information is provided for the 64 tumor samples on which this information was available.

Table 4 is a list of candidate genes at 1q21-q23 showing significantly increased expression in k2 versus k1 subgroups (FDR=15%) (see Materials and Methods in Example 1A)

Table 5 is a list of candidate genes at 13q14 showing significantly reduced expression in k2 versus k1 subgroups (FDR=15%) (see Materials and Methods in Example 1A).

Sequence Listing

Nucleotide and amino acid sequences are provided for the genes disclosed in the tables provided herein. The sequences provided are identified by G1 number, Genbank accession number, gene name and gene symbolG.

DETAILED DESCRIPTION OF THE INVENTION

The present invention is based, at least in part, on the identification of specific regions of the genome (referred to herein as minimal common regions (MCRs)), of recurrent copy number change which are contained within certain chromosomal regions (loci) and are associated with cancer. These MCRs were identified using a novel cDNA or oligomer-based platform and bioinformatics tools which allowed for the high-resolution characterization of copy-number alterations in the B cell cancer genome, e.g., multiple myeloma (MM) genome (see Example 1). To arrive at the identified loci and MCRs, array comparative genomic hybridization (array-CGH) was utilized to define copy number aberrations (CNAs) (gains and losses of chromosomal regions) in B cell cancer cell lines and tumor specimens. Four specific markers in MM have also been identified, namely SEMA4A, PRKCi, DHX36 and GPR89, by utilizing the materials and methods described herein (see Example 2).

Segmentation analysis of the raw profiles to filter noise from the data set (as described by Olshen and Venkatraman, Olshen, A. B., and Venkatraman, E. S. (2002) *ASA Proceedings of the Joint Statistical Meetings* 2530-2535; Ginzinger, D. G. (2002) *Exp Hematol* 30, 503-12; Golub, T. R., et al. (1999) *Science* 286, 531-7; Hyman, E., et al. (2002) *Cancer Res* 62, 6240-5; Lucito, R., et al. (2003) *Genome Res* 13, 2291-305) was performed and used to identify statistically significant changepoints in the data.

Identification of loci was based on an automated computer algorithm that utilized several basic criteria as follows: 1) segments above or below certain percentiles were identified as altered; 2) if two or more altered segments were adjacent in a single profile separated by less than 500 KB, the entire region spanned by the segments was considered to be an altered span; 3) highly altered segments or spans that were shorter than 20 MB were retained as "informative spans" for defining discrete locus boundaries. Longer regions were not discarded, but were not included in defining locus boundaries; 4) informative spans were compared across samples to identify overlapping groups of positive-value or negative-value segments; each group defines a locus; and 5) MCRs were defined as contiguous spans having at least 75% of the peak recurrence as calculated by counting the occurrence of highly altered segments. If two MCRs were separated by a gap of only one probe position, they were joined. If there were more than three MCRs in a locus, the whole region was reported as a single complex MCR.

A locus-identification algorithm was used that defines informative CNAs on the basis of size and achievement of a high significance threshold for the amplitude of change. Overlapping CNAs from multiple profiles were then merged in an automated fashion to define a discrete "locus" of regional copy number change, the bounds of which represent the combined physical extend to these overlapping CNAs. Each locus was characterized by a peak profile, the width and amplitude of which reflect the contour of the most prominent amplification or deletion for that locus. Furthermore, within each locus, one or more minimal common regions (MCRs) were identified across multiple tumor samples, with each MCR potentially harboring a distinct cancer-relevant gene targeted for copy number alteration across the sample set.

The locus-identification algorithm defined discrete MCRs within the data set which were annotated in terms of recurrence, amplitude of change and representation in both cell lines and primary tumors. These discrete MCRs were prioritized based on the presence in at least one primary tumor and intensity above 0.8 $\log_2$ ratio in at least one sample. Implementation of this prioritization scheme yielded 91 MCRs of the present invention (see Tables 1 or 2).

The confidence-level ascribed to these prioritized loci was further validated by real-time quantitative PCR (QPCR), which demonstrated 100% concordance with selected MCRs defined by array-CGH.

The MCRs identified herein possess a median size of 1.6 Mb, with 30% of the MCRs spanning 1 Mb or less, and possessing an average of 14 annotated genes.

Also in Tables 1 or 2, the loci and MCRs are indicated as having either "gain and amplification" or "loss and deletion," indicating that each locus and MCR has either (1) increased copy number and/or expression or (2) decreased copy number and/or expression, or deletion, in cancer. Furthermore, genes known to play important roles in the pathogenesis of B cell cancer (such as, p18, c-myc, cyclin D1, cyclin D3, c-maf, MMSET, FGFR3, p53, KRAS, NRAS, CDKN2A, CDKN2C, CDKN1B and PTEN) may also be analyzed.

Complementary expression profile analysis of a significant fraction of the genes residing within the MCRs of the present invention provided a subset of markers with statistically significant association between gene dosage and mRNA expression. Table 1 lists the markers of the invention which reside in MCRs of amplification that are overexpressed by comparison, across Multiple Myeloma cancer cell lines and tumors. Additional markers within the MCRs that have not yet been annotated may also be used as markers for cancer as described herein, and are included in the invention.

The novel methods for identifying chromosomal regions of altered copy number, as described herein, may be applied to various data sets for various diseases, including, but not limited to, cancer. Other methods may be used to determine copy number aberrations as are known in the art, including, but not limited to oligonucleotide-based microarrays (Brennan, et al. (2004) *In Press*; Lucito, et al. (2003) *Genome Res.* 13:2291-2305; Bignell et al. (2004) *Genome Res.* 14:287-295; Zhao, et al (2004) *Cancer Research,* 64(9):3060-71), and other methods as described herein including, for example, hybridization methods (such as, for example, FISH and FISH plus spectral karotype (SKY)).

The amplification or deletion of the MCRs identified herein correlate with the presence of cancer, e.g., B cell cancer and other hematopoietic cancers. Furthermore, analysis of copy number and/or expression levels of the genes residing within each MCR has led to the identification of individual markers and combinations of markers described herein, the increased and decreased expression and/or increased and decreased copy number of which correlate with the presence of cancer, e.g., B cell cancer, e.g., multiple myeloma, Waldenström's macroglobulinemia, the heavy chain diseases, such as, for example, alpha chain disease, gamma chain disease, and mu chain disease, benign monoclonal gammopathy, and immunocytic amyloidosis, in a subject.

Accordingly, methods are provided herein for detecting the presence of cancer in a sample, the absence of cancer in a sample, and other characteristics of cancer that are relevant to prevention, diagnosis, characterization, and therapy of cancer in a subject by evaluating alterations in the amount, structure, and/or activity of a marker. For example, evaluation of the presence, absence or copy number of the MCRs identified herein, or by evaluating the copy number, expression level, protein level, protein activity, presence of mutations (e.g., substitution, deletion, or addition mutations) which affect activity of the marker, or methylation status of any one or more of the markers within the MCRs (e.g., the markers set forth in Tables 1 and 2), is within the scope of the invention.

Methods are also provided herein for the identification of compounds which are capable of inhibiting cancer, in a subject, and for the treatment, prevention, and/or inhibition of cancer using a modulator, e.g., an agonist or antagonist, of a gene or protein marker of the invention.

Although the MCRs and markers described herein were identified in Multiple Myeloma samples, the methods of the invention are in no way limited to use for the prevention, diagnosis, characterization, therapy and prevention of B cell cancer, e.g., multiple myeloma, Waldenström's macroglobulinemia, the heavy chain diseases, such as, for example, alpha chain disease, gamma chain disease, and mu chain disease, benign monoclonal gammopathy, and immunocytic amyloidosis, and the methods of the invention may be applied to any cancer, as described herein.

Various aspects of the invention are described in further detail in the following subsections.

I. DEFINITIONS

As used herein, each of the following terms has the meaning associated with it in this section.

The articles "a" and "an" are used herein to refer to one or to more than one (i.e. to at least one) of the grammatical object of the article. By way of example, "an element" means one element or more than one element.

The terms "tumor" or "cancer" refer to the presence of cells possessing characteristics typical of cancer-causing cells, such as uncontrolled proliferation, immortality, metastatic potential, rapid growth and proliferation rate, and certain characteristic morphological features. Cancer cells are often in the form of a tumor, but such cells may exist alone within an animal, or may be a non-tumorigenic cancer cell, such as a leukemia cell. As used herein, the term "cancer" includes premalignant as well as malignant cancers. Cancers include, but are not limited to, B cell cancer, e.g., multiple myeloma, Waldenström's macroglobulinemia, the heavy chain diseases, such as, for example, alpha chain disease, gamma chain disease, and mu chain disease, benign monoclonal gammopathy, and immunocytic amyloidosis, melanomas, breast cancer, lung cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, and the like.

The terms "B cell cancer", "B cell neoplasia" or "B cell tumor" as used herein, includes neoplastic diseases involving proliferation of a single clone of cells producing a serum M component (a monoclonal immunoglobulin or immunoglobulin fragment). B cell cancer cells usually have plasma cell morphology, but may have lymphocytic or lymphoplasmacytic morphology. B cell cancer is intended to include, for example, multiple myeloma, Waldenström's macroglobulinemia, the heavy chain diseases, such as, for example, alpha chain disease, gamma chain disease, and mu chain disease, benign monoclonal gammopathy, and immunocytic amyloidosis. B cell cancer is also referred to a plasma cell dyscasia, dysproteinemias, monoclonal gammopathies or immunoglobulinopathies, and paraproteinemias. As used herein, B cell cancer is also intended to include the premalignant form of B cell cancer, e.g., multiple myeloma, referred to as monoclonal gammopathies of undetermined significance (MGUS). B cell cancer may be "metastatic" from another source (e.g., colon) or may be "primary" (a tumour of B cell origin). As used herein, B cell cancer is also intented to include "plasma cell cancer", "plasma cell neoplasms", and "plasma cell tumors", which include neoplastic diseases involving cells in the blood, specifically plasma cells.

As used herein, the term "B cell" is intended to include any of the cells in the art recognized developmental pathway that when mature or terminally differentiated produces and secretes antibodies, such as, for example, bone marrow stem cells, germinal center B cells, postgerminal center B cells, plasmablasts, and plasma cells.

A "minimal common region (MCR)," as used herein, refers to a contiguous chromosomal region which displays either gain and amplification (increased copy number) or loss and deletion (decreased copy number) in the genome of a cancer. An MCR includes at least one nucleic acid sequence which has increased or decreased copy number and which is associated with a cancer. The MCRs of the instant invention include, but are not limited to, those set forth in Tables 1 or 2.

A "marker" is a gene or protein which may be altered, wherein said alteration is associated with cancer. The alteration may be in amount, structure, and/or activity in a cancer tissue or cancer cell, as compared to its amount, structure, and/or activity, in a normal or healthy tissue or cell (e.g., a control), and is associated with a disease state, such as cancer. For example, a marker of the invention which is associated with cancer may have altered copy number, expression level, protein level, protein activity, or methylation status, in a cancer tissue or cancer cell as compared to a normal, healthy tissue or cell. Furthermore, a "marker" includes a molecule whose structure is altered, e.g., mutated (contains an allelic variant), e.g., differs from the wild type sequence at the nucleotide or amino acid level, e.g., by substitution, deletion, or addition, when present in a tissue or cell associated with a disease state, such as cancer.

The term "altered amount" of a marker or "altered level" of a marker refers to increased or decreased copy number of a marker or chromosomal region, e.g., MCR, and/or increased or decreased expression level of a particular marker gene or genes in a cancer sample, as compared to the expression level or copy number of the marker in a control sample. The term "altered amount" of a marker also includes an increased or decreased protein level of a marker in a sample, e.g., a cancer sample, as compared to the protein level of the marker in a normal, control sample. Furthermore, an altered amount of a marker may be determined by detecting the methylation status of a marker, as described herein, which may affect the expression or activity of a marker.

The amount of a marker, e.g., expression or copy number of a marker or MCR, or protein level of a marker, in a subject is "significantly" higher or lower than the normal amount of a marker or MCR, if the amount of the marker is greater or less, respectively, than the normal level by an amount greater than the standard error of the assay employed to assess amount, and preferably at least twice, and more preferably three, four, five, ten or more times that amount. Alternately, the amount of the marker or MCR in the subject can be considered "significantly" higher or lower than the normal amount if the amount is at least about two, and preferably at least about three, four, or five times, higher or lower, respectively, than the normal amount of the marker or MCR.

The "copy number of a gene" or the "copy number of a marker" refers to the number of DNA sequences in a cell encoding a particular gene product. Generally, for a given gene, a mammal has two copies of each gene. The copy number can be increased, however, by gene amplification or duplication, or reduced by deletion.

The "normal" copy number of a marker or MCR or "normal" level of expression of a marker is the level of expression, copy number of the marker, or copy number of the MCR, in a biological sample, e.g., a sample containing tissue, whole blood, serum, plasma, buccal scrape, saliva, cerebrospinal fluid, urine, stool, and bone marrow, from a subject, e.g., a human, not afflicted with cancer.

The term "altered level of expression" of a marker or MCR refers to an expression level or copy number of a marker in a test sample e.g., a sample derived from a patient suffering from cancer, that is greater or less than the standard error of the assay employed to assess expression or copy number, and is preferably at least twice, and more preferably three, four, five or ten or more times the expression level or copy number of the marker or MCR in a control sample (e.g., sample from a healthy subjects not having the associated disease) and preferably, the average expression level or copy number of the marker or MCR in several control samples. The altered level of expression is greater or less than the standard error of the assay employed to assess expression or copy number, and is preferably at least twice, and more preferably three, four, five or ten or more times the expression level or copy number of the marker or MCR in a control sample (e.g., sample from a healthy subjects not having the associated disease) and preferably, the average expression level or copy number of the marker or MCR in several control samples.

An "overexpression" or "significantly higher level of expression or copy number" of a marker or MCR refers to an expression level or copy number in a test sample that is greater than the standard error of the assay employed to assess expression or copy number, and is preferably at least twice, and more preferably three, four, five or ten or more times the expression level or copy number of the marker or MCR in a control sample (e.g., sample from a healthy subject not afflicted with cancer) and preferably, the average expression level or copy number of the marker or MCR in several control samples.

An "underexpression" or "significantly lower level of expression or copy number" of a marker or MCR refers to an expression level or copy number in a test sample that is greater than the standard error of the assay employed to assess expression or copy number, but is preferably at least twice, and more preferably three, four, five or ten or more times less than the expression level or copy number of the marker or MCR in a control sample (e.g., sample from a healthy subject not afflicted with cancer) and preferably, the average expression level or copy number of the marker or MCR in several control samples.

"Methylation status" of a marker refers to the methylation pattern, e.g., methylation of the promoter of the marker, and/or methylation levels of the marker. DNA methylation is a heritable, reversible and epigenetic change. Yet, DNA methylation has the potential to alter gene expression, which has developmental and genetic consequences. DNA methylation has been linked to cancer, as described in, for example, Laird, et al. (1994) *Human Molecular Genetics* 3:1487-1495 and Laird, P. (2003) *Nature* 3:253-266, the contents of which are incorporated herein by reference. For example, methylation of CpG oligonucleotides in the promoters of tumor suppressor genes can lead to their inactivation. In addition, alterations in the normal methylation process are associated with genomic instability (Lengauer. et al. *Proc. Natl. Acad. Sci. USA* 94:2545-2550, 1997). Such abnormal epigenetic changes may be found in many types of cancer and can, therefore, serve as potential markers for oncogenic transformation.

Methods for determining methylation include restriction landmark genomic scanning (Kawai, et al., *Mol. Cell. Biol.* 14:7421-7427, 1994), methylation-sensitive arbitrarily primed PCR (Gonzalgo, et al., *Cancer Res.* 57:594-599, 1997); digestion of genomic DNA with methylation-sensitive restriction enzymes followed by Southern analysis of the regions of interest (digestion-Southern method); PCR-based process that involves digestion of genomic DNA with methylation-sensitive restriction enzymes prior to PCR amplification (Singer-Sam, et al., *Nucl. Acids Res.* 18:687, 1990); genomic sequencing using bisulfite treatment (Frommer, et al., *Proc. Natl. Acad. Sci. USA* 89:1827-1831, 1992); methylation-specific PCR (MSP) (Herman, et al. *Proc. Natl. Acad. Sci. USA* 93:9821-9826, 1992); and restriction enzyme digestion of PCR products amplified from bisulfite-converted DNA (Sadri and Hornsby, *Nucl. Acids Res.* 24:5058-5059, 1996; and Xiong and Laird, *Nucl. Acids. Res.* 25:2532-2534, 1997); PCR techniques for detection of gene mutations (Kuppuswamy, et al., *Proc. Natl. Acad. Sci. USA* 88:1143-1147, 1991) and quantitation of allelic-specific expression (Szabo and Mann, *Genes Dev.* 9:3097-3108, 1995; and Singer-Sam, et al., *PCR Methods Appl.* 1: 160-163, 1992); and methods described in U.S. Pat. No. 6,251,594, the contents of which are incorporated herein by reference. An integrated genomic and epigenomic analysis as described in Zardo, et al. (2000) *Nature Genetics* 32:453-458, may also be used.

The term "altered activity" of a marker refers to an activity of a marker which is increased or decreased in a disease state, e.g., in a cancer sample, as compared to the activity of the marker in a normal, control sample. Altered activity of a marker may be the result of, for example, altered expression of the marker, altered protein level of the marker, altered structure of the marker, or, e.g., an altered interaction with other proteins involved in the same or different pathway as the marker or altered interaction with transcriptional activators or inhibitors, or altered methylation status.

The term "altered structure" of a marker refers to the presence of mutations or allelic variants within the marker gene or maker protein, e.g., mutations which affect expression or activity of the marker, as compared to the normal or wild-type gene or protein. For example, mutations include, but are not limited to substitutions, deletions, or addition mutations. Mutations may be present in the coding or non-coding region of the marker.

A "marker nucleic acid" is a nucleic acid (e.g., DNA, mRNA, cDNA) encoded by or corresponding to a marker of the invention. For example, such marker nucleic acid molecules include DNA (e.g., cDNA) comprising the entire or a partial sequence of any of the nucleic acid sequences set forth in Tables 4 or 5 or the complement or hybridizing fragment of such a sequence. The marker nucleic acid molecules also include RNA comprising the entire or a partial sequence of any of the nucleic acid sequences set forth in Tables 4 or 5 or the complement of such a sequence, wherein all thymidine residues are replaced with uridine residues. A "marker protein" is a protein encoded by or corresponding to a marker of the invention. A marker protein comprises the entire or a partial sequence of a protein encoded by any of the sequences set forth in Tables 4 or 5 or a fragment thereof. The terms "protein" and "polypeptide" are used interchangeably herein.

A "marker," as used herein, includes any nucleic acid sequence present in an MCR as set forth in Tables 1 or 2, or a protein encoded by such a sequence.

Markers identified herein include diagnostic and therapeutic markers. A single marker may be a diagnostic marker, a therapeutic marker, or both a diagnostic and therapeutic marker.

As used herein, the term "therapeutic marker" includes markers, e.g., markers set forth in Tables 1, 2, 3 and 4, which are believed to be involved in the development (including maintenance, progression, angiogenesis, and/or metastasis) of cancer. The cancer-related functions of a therapeutic marker may be confirmed by, e.g., (1) increased or decreased copy number (by, e.g., fluorescence in situ hybridization (FISH), and FISH plus spectral karotype (SKY), or quantitative PCR (qPCR)) or mutation (e.g., by sequencing), overexpression or underexpression (e.g., by in situ hybridization (ISH), Northern Blot, Affymetrix microarray analysis, or qPCR), increased or decreased protein levels (e.g., by immunohistochemistry (IHC)), or increased or decreased protein activity (determined by, for example, modulation of a pathway in which the marker is involved), e.g., in more than about 5%, 6%, 7%, 8%, 9%, 10%, 11%, 12%, 13%, 14%, 15%, 20%, 25%, or more of human cancers; (2) the inhibition of cancer cell proliferation and growth, e.g., in soft agar, by, e.g., RNA interference ("RNAi") of the marker; (3) the ability of the marker to enhance transformation of mouse embryo fibroblasts (MEFs) presenting or not engineered genetic lesions as for example the INK4a locus knock-out, by the action of oncogenes, e.g., Myc and KRAS2, ABL1, or by RAS alone; (4) the ability of the marker to enhance or decrease the growth of tumor cell lines, e.g., in soft agar; (5) the ability of the marker to transform primary mouse cells in SCID explant; and/or; (6) the prevention of maintenance or formation of tumors, e.g., tumors arising de novo in an animal or tumors derived from human cancer cell lines, by inhibiting or activating the marker. In one embodiment, a therapeutic marker may be used as a diagnostic marker.

As used herein, the term "diagnostic marker" includes markers, e.g., markers set forth in Tables 1, 2, 3 and 4, which are useful in the diagnosis of cancer, e.g., over- or underactivity emergence, expression, growth, remission, recurrence or resistance of tumors before, during or after therapy. The predictive functions of the marker may be confirmed by, e.g., (1) increased or decreased copy number (e.g., by FISH, FISH plus SKY, or qPCR), overexpression or underexpression (e.g., by ISH, Northern Blot, or qPCR), increased or decreased protein level (e.g., by IHC), or increased or decreased activity (determined by, for example, modulation of a pathway in which the marker is involved), e.g., in more than about 5%, 6%, 7%, 8%, 9%, 10%, 11%, 12%, 13%, 14%, 15%, 20%, 25%, or more of human cancers; (2) its presence or absence in a biological sample, e.g., a sample containing tissue, whole blood, serum, plasma, buccal scrape, saliva, cerebrospinal fluid, urine, stool, or bone marrow, from a subject, e.g. a human, afflicted with cancer; (3) its presence or absence in clinical subset of patients with cancer (e.g., those responding to a particular therapy or those developing resistance).

Diagnostic markers also include "surrogate markers," e.g., markers which are indirect markers of cancer progression.

The term "probe" refers to any molecule which is capable of selectively binding to a specifically intended target molecule, for example a marker of the invention. Probes can be either synthesized by one skilled in the art, or derived from appropriate biological preparations. For purposes of detection of the target molecule, probes may be specifically designed to be labeled, as described herein. Examples of molecules that can be utilized as probes include, but are not limited to, RNA, DNA, proteins, antibodies, and organic monomers.

As used herein, the term "promoter/regulatory sequence" means a nucleic acid sequence which is required for expression of a gene product operably linked to the promoter/regulatory sequence. In some instances, this sequence may be the core promoter sequence and in other instances, this sequence may also include an enhancer sequence and other regulatory elements which are required for expression of the gene product. The promoter/regulatory sequence may, for example, be one which expresses the gene product in a spatially or temporally restricted manner.

An "RNA interfering agent" as used herein, is defined as any agent which interferes with or inhibits expression of a target gene, e.g., a marker of the invention, by RNA interference (RNAi). Such RNA interfering agents include, but are not limited to, nucleic acid molecules including RNA molecules which are homologous to the target gene, e.g., a marker of the invention, or a fragment thereof, short interfering RNA (siRNA), and small molecules which interfere with or inhibit expression of a target gene by RNA interference (RNAi).

"RNA interference (RNAi)" is an evolutionarily conserved process whereby the expression or introduction of RNA of a sequence that is identical or highly similar to a target gene results in the sequence specific degradation or specific post-transcriptional gene silencing (PTGS) of messenger RNA (mRNA) transcribed from that targeted gene (see Coburn, G. and Cullen, B. (2002) *J. of Virology* 76(18):9225), thereby inhibiting expression of the target gene. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs or RNA interfering agents, to inhibit or silence the expression of target genes. As used herein, "inhibition of target gene expression" or "inhibition of marker gene expression" includes any decrease in expression or protein activity or level of the target gene (e.g., a marker gene of the invention) or protein encoded by the target gene, e.g., a marker protein of the invention. The decrease may be of at least 30%, 40%, 50%, 60%, 70%, 80%, 90%, 95% or 99% or more as compared to the expression of a target gene or the activity or level of the protein encoded by a target gene which has not been targeted by an RNA interfering agent.

"Short interfering RNA" (siRNA), also referred to herein as "small interfering RNA" is defined as an agent which functions to inhibit expression of a target gene, e.g., by RNAi. An siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the over hang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, an siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) *RNA* April 9(4):493-501 incorporated be reference herein).

RNA interfering agents, e.g., siRNA molecules, may be administered to a patient having or at risk for having cancer, to inhibit expression of a marker gene of the invention, e.g., a marker gene which is overexpressed in cancer (such as the markers listed in Tables 1 and 4) and thereby treat, prevent, or inhibit cancer in the subject.

A "constitutive" promoter is a nucleotide sequence which, when operably linked with a polynucleotide which encodes or specifies a gene product, causes the gene product to be produced in a living human cell under most or all physiological conditions of the cell.

An "inducible" promoter is a nucleotide sequence which, when operably linked with a polynucleotide which encodes or specifies a gene product, causes the gene product to be produced in a living human cell substantially only when an inducer which corresponds to the promoter is present in the cell.

A "tissue-specific" promoter is a nucleotide sequence which, when operably linked with a polynucleotide which encodes or specifies a gene product, causes the gene product to be produced in a living human cell substantially only if the cell is a cell of the tissue type corresponding to the promoter.

A "transcribed polynucleotide" is a polynucleotide (e.g. an RNA, a cDNA, or an analog of one of an RNA or cDNA) which is complementary to or homologous with all or a portion of a mature RNA made by transcription of a marker of the invention and normal post-transcriptional processing (e.g. splicing), if any, of the transcript, and reverse transcription of the transcript.

"Complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

The terms "homology" or "identity," as used interchangeably herein, refer to sequence similarity between two polynucleotide sequences or between two polypeptide sequences, with identity being a more strict comparison. The phrases "percent identity or homology" and "% identity or homology" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value there between. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences. The term "substantial homology," as used herein, refers to homology of at least 50%, more preferably, 60%, 70%, 80%, 90%, 95% or more.

A marker is "fixed" to a substrate if it is covalently or non-covalently associated with the substrate such the substrate can be rinsed with a fluid (e.g. standard saline citrate, pH 7.4) without a substantial fraction of the marker dissociating from the substrate.

As used herein, a "naturally-occurring" nucleic acid molecule refers to an RNA or DNA molecule having a nucleotide sequence that occurs in nature (e.g. encodes a natural protein).

Cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

A kit is any manufacture (e.g. a package or container) comprising at least one reagent, e.g. a probe, for specifically detecting a marker of the invention, the manufacture being promoted, distributed, or sold as a unit for performing the methods of the present invention.

II. USES OF THE INVENTION

The present invention is based, in part, on the identification of chromosomal regions (MCRs) which are structurally altered leading to a different copy number in cancer cells as compared to normal (i.e. non-cancerous) cells. Furthermore, the present invention is based, in part, on the identification of markers, e.g., markers which reside in the MCRs of the invention, which have an altered amount, structure, and/or activity in cancer cells as compared to normal (i.e., non-cancerous) cells. The markers of the invention correspond to DNA, cDNA, RNA, and polypeptide molecules which can be detected in one or both of normal and cancerous cells.

The amount, structure, and/or activity, e.g., the presence, absence, copy number, expression level, protein level, protein activity, presence of mutations, e.g., mutations which affect activity of the marker (e.g., substitution, deletion, or addition mutations), and/or methylation status, of one or more of these markers in a sample, e.g., a sample containing tissue, whole blood, serum, plasma, buccal scrape, saliva, cerebrospinal fluid, urine, stool, and bone marrow, is herein correlated with the cancerous state of the tissue. In addition, the presence, absence, and/or copy number of one or more of the MCRs of the invention in a sample is also correlated with the cancerous state of the tissue. The invention thus provides compositions, kits, and methods for assessing the cancerous state of cells (e.g. cells obtained from a non-human, cultured non-human cells, and in vivo cells) as well as methods for treatment, prevention, and/or inhibition of cancer using a modulator, e.g., an agonist or antagonist, of a marker of the invention.

The compositions, kits, and methods of the invention have the following uses, among others:

1) assessing whether a subject is afflicted with cancer;
2) assessing the stage of cancer in a human subject;
3) assessing the grade of cancer in a subject;
4) assessing the benign or malignant nature of cancer in a subject;
5) assessing the metastatic potential of cancer in a subject;
6) assessing the histological type of neoplasm associated with cancer in a subject;
7) making antibodies, antibody fragments or antibody derivatives that are useful for treating cancer and/or assessing whether a subject is afflicted with cancer;
8) assessing the presence of cancer cells;
9) assessing the efficacy of one or more test compounds for inhibiting cancer in a subject;
10) assessing the efficacy of a therapy for inhibiting cancer in a subject;
11) monitoring the progression of cancer in a subject;
12) selecting a composition or therapy for inhibiting cancer, e.g., in a subject;
13) treating a subject afflicted with cancer;
14) inhibiting cancer in a subject;
15) assessing the carcinogenic potential of a test compound; and
16) preventing the onset of cancer in a subject at risk for developing cancer.

The invention thus includes a method of assessing whether a subject is afflicted with cancer or is at risk for developing cancer. This method comprises comparing the amount, structure, and/or activity, e.g., the presence, absence, copy number, expression level, protein level, protein activity, presence of mutations, e.g., mutations which affect activity of the marker (e.g., substitution, deletion, or addition mutations), and/or methylation status, of a marker in a subject sample with the normal level. A significant difference between the amount, structure, or activity of the marker in the subject sample and the normal level is an indication that the subject is afflicted with cancer. The invention also provides a method for assessing whether a subject is afflicted with cancer or is at risk for developing cancer by comparing the level of expression of marker(s) within an MCR or copy number of an MCR in a cancer sample with the level of expression or copy number of the same marker(s) in a normal, control sample. A significant difference between the level of expression of marker(s) within an MCR or copy number of the MCR in the subject sample and the normal level is an indication that the subject is afflicted with cancer. The MCR is selected from the group consisting of those listed in Tables 1 or 2.

The marker may also be selected from the group consisting of the markers listed in Tables 4 and 5. Table 4 lists markers that are significantly upregulated in patients presenting gains in the chromosome 1q versus a group of patients having a similar aCGH profile that however do not show 1q gains. Table 4 also lists the chromosome, physical position in Mb, Affymetrix™ probe(s) number corresponding to each UniGene ID, Genebank Accession No. (i.e., "RefSeq" number), for each of the markers. Although one or more molecules corresponding to the markers listed in Table 4 may have been described by others, the significance of these markers with regard to the cancerous state of cells, has not previously been identified.

Table 5 also lists markers that are significantly downregulated in patients presenting losses in the chromosome 13 versus a group of patients having a similar aCGH profile that however do not show 13 losses. which have a highly significant correlation between gene expression and gene dosage (p, 0.05). Table 5 also lists the chromosome, physical position in Mb, Affymetrix™ probe(s) number corresponding to each UniGene ID, Genebank Accession No. (i.e., "GI" number), and SEQ ID NO. for each of these markers. Although one or more molecules corresponding to the markers listed in Table 5 may have been described by others, the significance of these markers with regard to the cancerous state of cells, has not previously been identified.

Any marker or combination of markers listed in Tables 4 or 5 or any MCR or combination of MCRs listed in Table 1 or 2, may be used in the compositions, kits, and methods of the present invention. In general, it is preferable to use markers for which the difference between the amount, e.g., level of expression or copy number, and/or activity of the marker or MCR in cancer cells and the amount, e.g., level of expression or copy number, and/or activity of the same marker in normal cells, is as great as possible. Although this difference can be as small as the limit of detection of the method for assessing amount and/or activity of the marker, it is preferred that the difference be at least greater than the standard error of the assessment method, and preferably a difference of at least 2-, 3-, 4-, 5-, 6-, 7-, 8-, 9-, 10-, 15-, 20-, 25-, 100-, 500-, 1000-fold or greater than the amount, e.g., level of expression or copy number, and/or activity of the same biomarker in normal tissue.

It is understood that by routine screening of additional subject samples using one or more of the markers of the invention, it will be realized that certain of the markers have altered amount, structure, and/or activity in cancers of various types, including specific B cell cancer, e.g., multiple myeloma, Waldenström's macroglobulinemia, the heavy chain-diseases, such as, for example, alpha chain disease, gamma chain disease, and mu chain disease, benign monoclonal gammopathy, and immunocytic amyloidosis, as well as other cancers, examples of which include, but are not limited to, melanomas, breast cancer, bronchus cancer, colorectal cancer, prostate cancer, lung cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematological tissues, and the like.

For example, it will be confirmed that some of the markers of the invention have altered amount, structure, and/or activity in some, i.e., 10%, 20%, 30%, or 40%, or most (i.e. 50% or more) or substantially all (i.e. 80% or more) of cancer, e.g., B cell cancer. Furthermore, it will be confirmed that certain of the markers of the invention are associated with cancer of various histologic subtypes.

In addition, as a greater number of subject samples are assessed for altered amount, structure, and/or activity of the markers or altered expression or copy number MCRs of the invention and the outcomes of the individual subjects from whom the samples were obtained are correlated, it will also be confirmed that markers have altered amount, structure, and/or activity of certain of the markers or altered expression or copy number of MCRs of the invention are strongly correlated with malignant cancers and that altered expression of other markers of the invention are strongly correlated with benign tumors or premalignant states. The compositions, kits, and methods of the invention are thus useful for characterizing one or more of the stage, grade, histological type, and benign/premalignant/malignant nature of cancer in subjects.

When the compositions, kits, and methods of the invention are used for characterizing one or more of the stage, grade, histological type, and benign/premalignant/malignant nature of cancer, in a subject, it is preferred that the marker or MCR or panel of markers or MCRs of the invention be selected such that a positive result is obtained in at least about 20%, and preferably at least about 40%, 60%, or 80%, and more preferably, in substantially all, subjects afflicted with cancer, of the corresponding stage, grade, histological type, or benign/premaligant/malignant nature. Preferably, the marker or panel of markers of the invention is selected such that a PPV (positive predictive value) of greater than about 10% is obtained for the general population (more preferably coupled with an assay specificity greater than 99.5%).

When a plurality of markers or MCRs of the invention are used in the compositions, kits, and methods of the invention, the amount, structure, and/or activity of each marker or level of expression or copy number can be compared with the normal amount, structure, and/or activity of each of the plurality of markers or level of expression or copy number, in non-cancerous samples of the same type, either in a single reaction mixture (i.e., using reagents, such as different fluorescent probes, for each marker) or in individual reaction mixtures corresponding to one or more of the markers or MCRs.

In one embodiment, a significantly altered amount, structure, and/or activity of more than one of the plurality of markers, or significantly altered copy number of one or more of the MCRs in the sample, relative to the corresponding normal levels, is an indication that the subject is afflicted with cancer. For example, a significantly lower copy number in the sample of each of the plurality of markers or MCRs, relative to the corresponding normal levels or copy number, is an indication that the subject is afflicted with cancer. In yet another embodiment, a significantly enhanced copy number of one or more markers or MCRs and a significantly lower level of expression or copy number of one or more markers or MCRs in a sample relative to the corresponding normal levels, is an indication that the subject is afflicted with cancer. Also, for example, a significantly enhanced copy number in the sample of each of the plurality of markers or MCRs, relative to the corresponding normal copy number, is an indication that the subject is afflicted with cancer. In yet another embodiment, a significantly enhanced copy number of one or more markers or MCRs and a significantly lower copy number of one or more markers or MCRs in a sample relative to the corresponding normal levels, is an indication that the subject is afflicted with cancer.

When a plurality of markers or MCRs are used, it is preferred that 2, 3, 4, 5, 8, 10, 12, 15, 20, 30, or 50 or more individual markers or MCRs be used or identified, wherein fewer markers or MCRs are preferred.

Only a small number of markers are known to be associated with, for example, B cell cancer (e.g., p18, c-myc, p53, K-Ras, cyclin D1, cyclin D3, c-maf, MMSET, and FGFR3). These markers or other markers which are known to be associated with other types of cancer may be used together with one or more markers of the invention in, for example, a panel of markers. In addition, frequent gains have been mapped to 1q31, 3q25-27, 5p13-14 and 8q23-24 and losses to 3p21, 8p22, 9p21-22, 13q22, and 17p12-13 (Bjorkqvist, A. M., et al. (1998) *Br J Cancer* 77, 260-9; Luk, C., et al. (2001) *Cancer Genet Cytogenet* 125, 87-99; Pei, J., et al. (2001) *Genes Chromosomes Cancer* 31, 282-7; Petersen, I., et al. (1997) *Cancer Res* 57, 2331-5; Balsara, B. R. & Testa, J. R. (2002) *Oncogene* 21, 6877-83) in B cell cancer. In some instances, validated oncogenes and tumor suppressor genes residing within these loci, including p27, RB1, TP53, MYC, KRAS, NRAS, ABL1, PRAD1, CDKN2A, CDKN2C, CDKN1B and PTEN may be analyzed. It is well known that certain types of genes, such as oncogenes, tumor suppressor genes, growth factor-like genes, protease-like genes, and protein kinase-like genes are often involved with development of cancers of various types. Thus, among the markers of the invention, use of those which correspond to proteins which resemble known proteins encoded by known oncogenes and tumor suppressor genes, and those which correspond to proteins which resemble growth factors, proteases, and protein kinases, are preferred.

It is recognized that the compositions, kits, and methods of the invention will be of particular utility to subjects having an enhanced risk of developing cancer, and their medical advisors. Subjects recognized as having an enhanced risk of developing cancer, include, for example, subjects having a familial history of cancer, subjects identified as having a mutant oncogene (i.e. at least one allele), subjects with monoclonal gammopathies of undetermined significance (MGUS) and subjects of advancing age.

An alteration, e.g. copy number, amount, structure, and/or activity of a marker in normal (i.e. non-cancerous) human tissue can be assessed in a variety of ways. In one embodiment, the normal level of expression or copy number is assessed by assessing the level of expression and/or copy number of the marker or MCR in a portion of cells which appear to be non-cancerous and by comparing this normal level of expression or copy number with the level of expression or copy number in a portion of the cells which are suspected of being cancerous. For example, when a bone marrow biopsy, laparoscopy or other medical procedure, reveals the presence of a tumor on one portion of an organ, the normal level of expression or copy number of a marker or MCR may be assessed using the non-affected portion of the organ, and this normal level of expression or copy number may be compared with the level of expression or copy number of the same marker in an affected portion (i.e., the tumor) of the organ. Alternately, and particularly as further information becomes available as a result of routine performance of the methods described herein, population-average values for "normal" copy number, amount, structure, and/or activity of the markers or MCRs of the invention may be used. In other embodiments, the "normal" copy number, amount, structure, and/or activity of a marker or MCR may be determined by assessing copy number, amount, structure, and/or activity of the marker or MCR in a subject sample obtained from a non-cancer-afflicted subject, from a subject sample obtained from a subject before the suspected onset of cancer in the subject, from archived subject samples, and the like.

The invention includes compositions, kits, and methods for assessing the presence of cancer cells in a sample (e.g. an archived tissue sample or a sample obtained from a subject). These compositions, kits, and methods are substantially the same as those described above, except that, where necessary, the compositions, kits, and methods are adapted for use with certain types of samples. For example, when the sample is a parafinized, archived human tissue sample, it may be necessary to adjust the ratio of compounds in the compositions of the invention, in the kits of the invention, or the methods used. Such methods are well known in the art and within the skill of the ordinary artisan.

The invention thus includes a kit for assessing the presence of cancer cells (e.g. in a sample such as a subject sample). The kit may comprise one or more reagents capable of identifying a marker or MCR of the invention, e.g., binding specifically with a nucleic acid or polypeptide corresponding to a marker or MCR of the invention. Suitable reagents for binding with a polypeptide corresponding to a marker of the invention include antibodies, antibody derivatives, antibody fragments, and the like. Suitable reagents for binding with a nucleic acid (e.g. a genomic DNA, an mRNA, a spliced mRNA, a cDNA, or the like) include complementary nucleic acids. For example, the nucleic acid reagents may include oligonucleotides (labeled or non-labeled) fixed to a substrate, labeled oligonucleotides not bound with a substrate, pairs of PCR primers, molecular beacon probes, and the like.

The kit of the invention may optionally comprise additional components useful for performing the methods of the invention. By way of example, the kit may comprise fluids (e.g., SSC buffer) suitable for annealing complementary nucleic acids or for binding an antibody with a protein with which it specifically binds, one or more sample compartments, an instructional material which describes performance of a method of the invention, a sample of normal cells, a sample of cancer cells, and the like.

A kit of the invention may comprise a reagent useful for determining protein level or protein activity of a marker. In another embodiment, a kit of the invention may comprise a reagent for determining methylation status of a marker, or may comprise a reagent for determining alteration of structure of a marker, e.g., the presence of a mutation.

The invention also includes a method of making an isolated hybridoma which produces an antibody useful in methods and kits of the present invention. A protein corresponding to a marker of the invention may be isolated (e.g. by purification from a cell in which it is expressed or by transcription and translation of a nucleic acid encoding the protein in vivo or in vitro using known methods) and a vertebrate, preferably a mammal such as a mouse, rat, rabbit, or sheep, is immunized using the isolated protein. The vertebrate may optionally (and preferably) be immunized at least one additional time with the isolated protein, so that the vertebrate exhibits a robust immune response to the protein. Splenocytes are isolated from the immunized vertebrate and fused with an immortalized cell line to form hybridomas, using any of a variety of methods well known in the art. Hybridomas formed in this manner are then screened using standard methods to identify one or more hybridomas which produce an antibody which specifically binds with the protein. The invention also includes hybridomas made by this method and antibodies made using such hybridomas.

The invention also includes a method of assessing the efficacy of a test compound for inhibiting cancer cells. As described above, differences in the amount, structure, and/or activity of the markers of the invention, or level of expression or copy number of the MCRs of the invention, correlate with the cancerous state of cells. Although it is recognized that changes in the levels of amount, e.g., expression or copy number, structure, and/or activity of certain of the markers or expression or copy number of the MCRs of the invention likely result from the cancerous state of cells, it is likewise recognized that changes in the amount may induce, maintain, and promote the cancerous state. Thus, compounds which inhibit cancer, in a subject may cause a change, e.g., a change in expression and/or activity of one or more of the markers of the invention to a level nearer the normal level for that marker (e.g., the amount, e.g., expression, and/or activity for the marker in non-cancerous cells).

This method thus comprises comparing amount, e.g., expression, and/or activity of a marker in a first cell sample and maintained in the presence of the test compound and amount, e.g., expression, and/or activity of the marker in a second cell sample and maintained in the absence of the test compound. A significant increase in the amount, e.g., expression, and/or activity of a marker listed in Tables 2 or 5 (e.g., a marker that was shown to be decreased in cancer), a significant decrease in the amount, e.g., expression, and/or activity of a marker listed in Tables 1 or 4 (e.g., a marker that was shown to be increased in cancer), is an indication that the test compound inhibits cancer. The cell samples may, for example, be aliquots of a single sample of normal cells obtained from a subject, pooled samples of normal cells obtained from a subject, cells of a normal cell lines, aliquots of a single sample of cancer, cells obtained from a subject, pooled samples of cancer, cells obtained from a subject, cells of a cancer cell line, cells from an animal model of cancer, or the like. In one embodiment, the samples are cancer cells obtained from a subject and a plurality of compounds known to be effective for inhibiting various cancers, are tested in order to identify the compound which is likely to best inhibit the cancer in the subject.

This method may likewise be used to assess the efficacy of a therapy, e.g., chemotherapy, radiation therapy, surgery, or any other therapeutic approach useful for inhibiting cancer in a subject. In this method, the amount, e.g., expression, and/or activity of one or more markers of the invention in a pair of samples (one subjected to the therapy, the other not subjected to the therapy) is assessed. As with the method of assessing the efficacy of test compounds, if the therapy induces a significant decrease in the amount, e.g., expression, and/or activity of a marker listed in Tables 1 or 4 (e.g., a marker that was shown to be increased in cancer), blocks induction of a marker listed in Tables 1 or 4 (e.g., a marker that was shown to be increased in cancer), or if the therapy induces a significant enhancement of the amount, e.g., expression, and/or activity of a marker listed in Tables 2 or 5 (e.g., a marker that was shown to be decreased in cancer), then the therapy is efficacious for inhibiting cancer. As above, if samples from a selected subject are used in this method, then alternative therapies can be assessed in vitro in order to select a therapy most likely to be efficacious for inhibiting cancer in the subject.

This method may likewise be used to monitor the progression of cancer in a subject, wherein if a sample in a subject has a significant decrease in the amount, e.g., expression, and/or activity of a marker listed in Tables 1 or 4 (e.g., a marker that was shown to be increased in cancer, or blocks induction of a marker listed in Tables 1 or 4 (e.g., a marker that was shown to be increased in cancer), or a significant enhancement of the amount, e.g., expression, and/or activity of a marker listed in Tables 2 or 5 (e.g., a marker that was shown to be decreased in cancer), during the progression of cancer, e.g., at a first point in time and a subsequent point in time, then the cancer has improved. In yet another embodiment, between the first point in time and a subsequent point in time, the subject has undergone treatment, e.g., chemotherapy, radiation therapy, surgery, or any other therapeutic approach useful for inhibiting cancer, has completed treatment, or is in remission.

As described herein, cancer in subjects is associated with an increase in amount, e.g., expression, and/or activity of one or more markers listed in Table 1 or 4 (e.g., a marker that was shown to be increased in cancer), and/or a decrease in amount, e.g., expression, and/or activity of one or more markers listed in Tables 2 or 5 (e.g., a marker that was shown to be decreased in cancer). While, as discussed above, some of these changes in amount, e.g., expression, and/or activity number result from occurrence of the cancer, others of these changes induce, maintain, and promote the cancerous state of cancer cells. Thus, cancer characterized by an increase in the amount, e.g., expression, and/or activity of one or more markers listed in Tables 1 or 4 (e.g., a marker that was shown to be increased in cancer), can be inhibited by inhibiting amount, e.g., expression, and/or activity of those markers. Likewise, cancer characterized by a decrease in the amount, e.g., expression, and/or activity of one or more markers listed in Tables 2 or 5 (e.g., a marker that was shown to be decreased in cancer), can be inhibited by enhancing amount, e.g., expression, and/or activity of those markers.

Amount and/or activity of a marker listed in Tables 1 or 4 (e.g., a marker that was shown to be increased in cancer), can be inhibited in a number of ways generally known in the art. For example, an antisense oligonucleotide can be provided to the cancer cells in order to inhibit transcription, translation, or both, of the marker(s). An RNA interfering agent, e.g., an siRNA molecule, which is targeted to a marker listed in Tables 1 or 4, can be provided to the cancer cells in order to inhibit expression of the target marker, e.g., through degradation or specific post-transcriptional gene silencing (PTGS) of the messenger RNA (mRNA) of the target marker. Alternately, a polynucleotide encoding an antibody, an antibody derivative, or an antibody fragment, e.g., a fragment capable of binding an antigen, and operably linked with an appropriate promoter or regulator region, can be provided to the cell in order to generate intracellular antibodies which will inhibit the function, amount, and/or activity of the protein corresponding to the marker(s). Conjugated antibodies or fragments thereof, e.g., chemolabeled antibodies, radiolabeled antibodies, or immunotoxins targeting a marker of the invention may also be administered to treat, prevent or inhibit cancer.

A small molecule may also be used to modulate, e.g., inhibit, expression and/or activity of a marker listed in Tables 1 or 4. In one embodiment, a small molecule functions to disrupt a protein-protein interaction between a marker of the invention and a target molecule or ligand, thereby modulating, e.g., increasing or decreasing the activity of the marker.

Using the methods described herein, a variety of molecules, particularly including molecules sufficiently small that they are able to cross the cell membrane, can be screened in order to identify molecules which inhibit amount and/or activity of the marker(s). The compound so identified can be provided to the subject in order to inhibit amount and/or activity of the marker(s) in the cancer cells of the subject.

Amount and/or activity of a marker listed in Tables 2 or 5 (e.g., a marker that was shown to be decreased in cancer), can be enhanced in a number of ways generally known in the art. For example, a polynucleotide encoding the marker and operably linked with an appropriate promoter/regulator region can be provided to cells of the subject in order to induce enhanced expression and/or activity of the protein (and mRNA) corresponding to the marker therein. Alternatively, if the protein is capable of crossing the cell membrane, inserting itself in the cell membrane, or is normally a secreted protein, then amount and/or activity of the protein can be enhanced by providing the protein (e.g. directly or by way of the bloodstream) to cancer cells in the subject. A small molecule may also be used to modulate, e.g., increase, expression or activity of a marker listed in Tables 2 or 5. Furthermore, in another embodiment, a modulator of a marker of the invention, e.g., a small molecule, may be used, for example, to re-express a silenced gene, e.g., a tumor suppressor, in order to treat or prevent cancer. For example, such a modulator may interfere with a DNA binding element or a methyltransferase.

As described above, the cancerous state of human cells is correlated with changes in the amount and/or activity of the markers of the invention. Thus, compounds which induce increased expression or activity of one or more of the markers listed in Tables 1 or 4 (e.g., a marker that was shown to be increased in cancer), decreased amount and/or activity of one or more of the markers listed in Tables 2 or 5 (e.g., a marker that was shown to be decreased in cancer), can induce cell carcinogenesis. The invention also includes a method for assessing the human cell carcinogenic potential of a test compound. This method comprises maintaining separate aliquots of human cells in the presence and absence of the test compound. Expression or activity of a marker of the invention in each of the aliquots is compared. A significant increase in the amount and/or activity of a marker listed in Tables 1 or 4 (e.g., a marker that was shown to be increased in cancer), or a significant decrease in the amount and/or activity of a marker listed in Tables 2 or 5 (e.g., a marker that was shown to be decreased in cancer), in the aliquot maintained in the presence of the test compound (relative to the aliquot maintained in the absence of the test compound) is an indication that the test compound possesses human cell carcinogenic potential. The relative carcinogenic potentials of various test compounds can be assessed by comparing the degree of enhancement or inhibition of the amount and/or activity of the relevant markers, by comparing the number of markers for which the amount and/or activity is enhanced or inhibited, or by comparing both.

Various aspects of the invention are described in further detail in the following subsections.

III. ISOLATED NUCLEIC ACID MOLECULES

One aspect of the invention pertains to isolated nucleic acid molecules that correspond to a marker of the invention, including nucleic acids which encode a polypeptide corresponding to a marker of the invention or a portion of such a polypeptide. The nucleic acid molecules of the invention include those nucleic acid molecules which reside in the MCRs identified herein. Isolated nucleic acid molecules of the invention also include nucleic acid molecules sufficient for use as hybridization probes to identify nucleic acid molecules that correspond to a marker of the invention, including nucleic acid molecules which encode a polypeptide corresponding to a marker of the invention, and fragments of such nucleic acid molecules, e.g., those suitable for use as PCR primers for the amplification or mutation of nucleic acid molecules. As used herein, the term "nucleic acid molecule" is intended to include DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule is one which is separated from other nucleic acid molecules which are present in the natural source of the nucleic acid molecule. Preferably, an "isolated" nucleic acid molecule is free of sequences (preferably protein-encoding sequences) which naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kB, 4 kB, 3 kB, 2 kB, 1 kB, 0.5 kB or 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

A nucleic acid molecule of the present invention, e.g., a nucleic acid molecules encoding a protein corresponding to a marker listed in Tables 1, 2, 4 or 5, can be isolated using standard molecular biology techniques and the sequence information in the database records described herein. Using all or a portion of such nucleic acid sequences, nucleic acid molecules of the invention can be isolated using standard hybridization and cloning techniques (e.g., as described in Sambrook et al., ed., *Molecular Cloning: A Laboratory Manual*, 2nd ed., Cold Spring Harbor Laboratory Press, Cold Spring Harbor, N.Y., 1989).

A nucleic acid molecule of the invention can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule of the invention can be prepared by standard synthetic techniques, e.g., using an automated DNA synthesizer.

In another preferred embodiment, an isolated nucleic acid molecule of the invention comprises a nucleic acid molecule which has a nucleotide sequence complementary to the nucleotide sequence of a nucleic acid corresponding to a marker of the invention or to the nucleotide sequence of a nucleic acid encoding a protein which corresponds to a marker of the invention. A nucleic acid molecule which is complementary to a given nucleotide sequence is one which is sufficiently complementary to the given nucleotide sequence that it can hybridize to the given nucleotide sequence thereby forming a stable duplex.

Moreover, a nucleic acid molecule of the invention can comprise only a portion of a nucleic acid sequence, wherein the full length nucleic acid sequence comprises a marker of the invention or which encodes a polypeptide corresponding to a marker of the invention. Such nucleic acid molecules can be used, for example, as a probe or primer. The probe/primer typically is used as one or more substantially purified oligonucleotides. The oligonucleotide typically comprises a region of nucleotide sequence that hybridizes under stringent conditions to at least about 7, preferably about 15, more preferably about 25, 50, 75, 100, 125, 150, 175, 200, 250, 300, 350, or 400 or more consecutive nucleotides of a nucleic acid of the invention.

Probes based on the sequence of a nucleic acid molecule of the invention can be used to detect transcripts or genomic sequences corresponding to one or more markers of the invention. The probe comprises a label group attached thereto, e.g., a radioisotope, a fluorescent compound, an enzyme, or an enzyme co-factor. Such probes can be used as part of a diagnostic test kit for identifying cells or tissues which mis-express the protein, such as by measuring levels of a nucleic acid molecule encoding the protein in a sample of cells from a subject, e.g., detecting mRNA levels or determining whether a gene encoding the protein has been mutated or deleted.

The invention further encompasses nucleic acid molecules that differ, due to degeneracy of the genetic code, from the nucleotide sequence of nucleic acid molecules encoding a protein which corresponds to a marker of the invention, and thus encode the same protein.

In addition to the nucleotide sequences described in Tables 4 or 5, it will be appreciated by those skilled in the art that DNA sequence polymorphisms that lead to changes in the amino acid sequence can exist within a population (e.g., the human population). Such genetic polymorphisms can exist among individuals within a population due to natural allelic variation. An allele is one of a group of genes which occur alternatively at a given genetic locus. In addition, it will be appreciated that DNA polymorphisms that affect RNA expression levels can also exist that may affect the overall expression level of that gene (e.g., by affecting regulation or degradation).

The term "allele," which is used interchangeably herein with "allelic variant," refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene or allele. Alleles of a specific gene, including, but not limited to, the genes listed in Tables 1, 2, 4 or 5, can differ from each other in a single nucleotide, or several nucleotides, and can include substitutions, deletions, and insertions of nucleotides. An allele of a gene can also be a form of a gene containing one or more mutations.

The term "allelic variant of a polymorphic region of gene" or "allelic variant", used interchangeably herein, refers to an alternative form of a gene having one of several possible nucleotide sequences found in that region of the gene in the population. As used herein, allelic variant is meant to encompass functional allelic variants, non-functional allelic variants, SNPs, mutations and polymorphisms.

The term "single nucleotide polymorphism" (SNP) refers to a polymorphic site occupied by a single nucleotide, which is the site of variation between allelic sequences. The site is usually preceded by and followed by highly conserved sequences of the allele (e.g., sequences that vary in less than $1/100$ or $1/1000$ members of a population). A SNP usually arises due to substitution of one nucleotide for another at the polymorphic site. SNPs can also arise from a deletion of a nucleotide or an insertion of a nucleotide relative to a reference allele. Typically the polymorphic site is occupied by a base other than the reference base. For example, where the reference allele contains the base "T" (thymidine) at the polymorphic site, the altered allele can contain a "C" (cytidine), "G" (guanine), or "A" (adenine) at the polymorphic site. SNP's may occur in protein-coding nucleic acid sequences, in which case they may give rise to a defective or otherwise variant protein, or genetic disease. Such a SNP may alter the coding sequence of the gene and therefore specify another amino acid (a "missense" SNP) or a SNP may introduce a stop codon (a "nonsense" SNP). When a SNP does not alter the amino acid sequence of a protein, the SNP is called "silent." SNP's may also occur in noncoding regions of the nucleotide sequence. This may result in defective protein expression, e.g., as a result of alternative spicing, or it may have no effect on the function of the protein.

As used herein, the terms "gene" and "recombinant gene" refer to nucleic acid molecules comprising an open reading frame encoding a polypeptide corresponding to a marker of the invention. Such natural allelic variations can typically result in 1-5% variance in the nucleotide sequence of a given gene. Alternative alleles can be identified by sequencing the gene of interest in a number of different individuals. This can be readily carried out by using hybridization probes to identify the same genetic locus in a variety of individuals. Any and all such nucleotide variations and resulting amino acid polymorphisms or variations that are the result of natural allelic variation and that do not alter the functional activity are intended to be within the scope of the invention.

In another embodiment, an isolated nucleic acid molecule of the invention is at least 7, 15, 20, 25, 30, 40, 60, 80, 100, 150, 200, 250, 300, 350, 400, 450, 550, 650, 700, 800, 900, 1000, 1200, 1400, 1600, 1800, 2000, 2200, 2400, 2600, 2800, 3000, 3500, 4000, 4500, or more nucleotides in length and hybridizes under stringent conditions to a nucleic acid molecule corresponding to a marker of the invention or to a nucleic acid molecule encoding a protein corresponding to a marker of the invention. As used herein, the term "hybridizes under stringent conditions" is intended to describe conditions for hybridization and washing under which nucleotide sequences at least 60% (65%, 70%, 75%, 80%, preferably 85%) identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). A preferred, non-limiting example of stringent hybridization conditions are hybridization in 6× sodium chloride/sodium citrate (SSC) at about 45° C., followed by one or more washes in 0.2×SSC, 0.1% SDS at 50-65° C.

In addition to naturally-occurring allelic variants of a nucleic acid molecule of the invention that can exist in the population, the skilled artisan will further appreciate that sequence changes can be introduced by mutation thereby leading to changes in the amino acid sequence of the encoded protein, without altering the biological activity of the protein encoded thereby. For example, one can make nucleotide substitutions leading to amino acid substitutions at "non-essential" amino acid residues. A "non-essential" amino acid residue is a residue that can be altered from the wild-type sequence without altering the biological activity, whereas an "essential" amino acid residue is required for biological activity. For example, amino acid residues that are not conserved or only semi-conserved among homologs of various species may be non-essential for activity and thus would be likely targets for alteration. Alternatively, amino acid residues that are conserved among the homologs of various species (e.g., murine and human) may be essential for activity and thus would not be likely targets for alteration.

Accordingly, another aspect of the invention pertains to nucleic acid molecules encoding a polypeptide of the invention that contain changes in amino acid residues that are not essential for activity. Such polypeptides differ in amino acid sequence from the naturally-occurring proteins which correspond to the markers of the invention, yet retain biological activity. In one embodiment, such a protein has an amino acid sequence that is at least about 40% identical, 50%, 60%, 70%, 80%, 90%, 95%, or 98% identical to the amino acid sequence of one of the proteins which correspond to the markers of the invention.

An isolated nucleic acid molecule encoding a variant protein can be created by introducing one or more nucleotide substitutions, additions or deletions into the nucleotide sequence of nucleic acids of the invention, such that one or more amino acid residue substitutions, additions, or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), non-polar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity. Following mutagenesis, the encoded protein can be expressed recombinantly and the activity of the protein can be determined.

The present invention encompasses antisense nucleic acid molecules, i.e., molecules which are complementary to a sense nucleic acid of the invention, e.g., complementary to the coding strand of a double-stranded cDNA molecule corresponding to a marker of the invention or complementary to an mRNA sequence corresponding to a marker of the invention. Accordingly, an antisense nucleic acid molecule of the invention can hydrogen bond to (i.e. anneal with) a sense nucleic acid of the invention. The antisense nucleic acid can be complementary to an entire coding strand, or to only a portion thereof, e.g., all or part of the protein coding region (or open reading frame). An antisense nucleic acid molecule can also be antisense to all or part of a non-coding region of the coding strand of a nucleotide sequence encoding a polypeptide of the invention. The non-coding regions ("5' and 3' untranslated regions") are the 5' and 3' sequences which flank the coding region and are not translated into amino acids.

An antisense oligonucleotide can be, for example, about 5, 10, 15, 20, 25, 30, 35, 40, 45, or 50 or more nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a polypeptide corresponding to a selected marker of the invention to thereby inhibit expression of the marker, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. Examples of a route of administration of antisense nucleic acid molecules of the invention includes direct injection at a tissue site or infusion of the antisense nucleic acid into a blood- or bone marrow-associated body fluid. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

An antisense nucleic acid molecule of the invention can be an α-anomeric nucleic acid molecule. An α-anomeric nucleic acid molecule forms specific double-stranded hybrids with complementary RNA in which, contrary to the usual α-units, the strands run parallel to each other (Gaultier et al., 1987, *Nucleic Acids Res.* 15:6625-6641). The antisense nucleic acid molecule can also comprise a 2'-o-methylribonucleotide (Inoue et al., 1987, *Nucleic Acids Res.* 15:6131-6148) or a chimeric RNA-DNA analogue (Inoue et al., 1987, *FEBS Lett.* 215:327-330).

The invention also encompasses ribozymes. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes as described in Haselhoff and Gerlach, 1988, *Nature* 334:585-591) can be used to catalytically cleave mRNA transcripts to thereby inhibit translation of the protein encoded by the mRNA. A ribozyme having specificity for a nucleic acid molecule encoding a polypeptide corresponding to a marker of the invention can be designed based upon the nucleotide sequence of a cDNA corresponding to the marker. For example, a derivative of a Tetrahymena L-19 IVS RNA can be constructed in which the nucleotide sequence of the active site is complementary to the nucleotide sequence to be cleaved (see Cech et al. U.S. Pat. No. 4,987,071; and Cech et al. U.S. Pat. No. 5,116,742). Alternatively, an mRNA encoding a polypeptide of the invention can be used to select a catalytic RNA having a specific ribonuclease activity from a pool of RNA molecules (see, e.g., Bartel and Szostak, 1993, *Science* 261:1411-1418).

The invention also encompasses nucleic acid molecules which form triple helical structures. For example, expression of a polypeptide of the invention can be inhibited by targeting nucleotide sequences complementary to the regulatory region of the gene encoding the polypeptide (e.g., the promoter and/or enhancer) to form triple helical structures that prevent transcription of the gene in target cells. See generally Helene (1991) *Anticancer Drug Des.* 6(6):569-84; Helene (1992) *Ann. N.Y. Acad. Sci.* 660:27-36; and Maher (1992) *Bioassays* 14(12):807-15.

In various embodiments, the nucleic acid molecules of the invention can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acid molecules (see Hyrup et al., 1996, *Bioorganic & Medicinal Chemistry* 4(1): 5-23). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid phase peptide synthesis protocols as described in Hyrup et al. (1996), supra; Perry-O'Keefe et al. (1996) *Proc. Natl. Acad. Sci. USA* 93:14670-675.

PNAs can be used in therapeutic and diagnostic applications. For example, PNAs can be used as antisense or antigene agents for sequence-specific modulation of gene expression by, e.g., inducing transcription or translation arrest or inhibiting replication. PNAs can also be used, e.g., in the analysis of single base pair mutations in a gene by, e.g., PNA directed PCR clamping; as artificial restriction enzymes when used in combination with other enzymes, e.g., S1 nucleases (Hyrup (1996), supra; or as probes or primers for DNA sequence and hybridization (Hyrup, 1996, supra; Perry-O'Keefe et al., 1996, *Proc. Natl. Acad. Sci. USA* 93:14670-675).

In another embodiment, PNAs can be modified, e.g., to enhance their stability or cellular uptake, by attaching lipophilic or other helper groups to PNA, by the formation of PNA-DNA chimeras, or by the use of liposomes or other techniques of drug delivery known in the art. For example, PNA-DNA chimeras can be generated which can combine the advantageous properties of PNA and DNA. Such chimeras allow DNA recognition enzymes, e.g., RNASE H and DNA polymerases, to interact with the DNA portion while the PNA portion would provide high binding affinity and specificity. PNA-DNA chimeras can be linked using linkers of appropriate lengths selected in terms of base stacking, number of bonds between the nucleobases, and orientation (Hyrup, 1996, supra). The synthesis of PNA-DNA chimeras can be performed as described in Hyrup (1996), supra, and Finn et al. (1996) *Nucleic Acids Res.* 24(17):3357-63. For example, a DNA chain can be synthesized on a solid support using standard phosphoramidite coupling chemistry and modified nucleoside analogs. Compounds such as 5'-(4-methoxytrityl) amino-5'-deoxy-thymidine phosphoramidite can be used as a link between the PNA and the 5' end of DNA (Mag et al., 1989, Nucleic Acids Res. 17:5973-88). PNA monomers are then coupled in a step-wise manner to produce a chimeric molecule with a 5' PNA segment and a 3' DNA segment (Finn et al., 1996, *Nucleic Acids Res.* 24(17):3357-63). Alternatively, chimeric molecules can be synthesized with a 5' DNA segment and a 3' PNA segment (Peterser et al., 1975, *Bioorganic Med. Chem. Lett.* 5:1119-11124).

In other embodiments, the oligonucleotide can include other appended groups such as peptides (e.g., for targeting host cell receptors in vivo), or agents facilitating transport across the cell membrane (see, e.g., Letsinger et al., 1989, *Proc. Natl. Acad. Sci. USA* 86:6553-6556; Lemaitre et al., 1987, *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al., 1988, *Bio/Techniques* 6:958-976) or intercalating agents (see, e.g., Zon, 1988, *Pharm. Res.* 5:539-549). To this end, the oligonucleotide can be conjugated to another molecule, e.g., a peptide, hybridization triggered cross-linking agent, transport agent, hybridization-triggered cleavage agent, etc.

The invention also includes molecular beacon nucleic acid molecules having at least one region which is complementary to a nucleic acid molecule of the invention, such that the molecular beacon is useful for quantitating the presence of the nucleic acid molecule of the invention in a sample. A "molecular beacon" nucleic acid is a nucleic acid molecule comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid molecules are not annealed with one another, fluorescence of the fluorophore is quenched to a lesser degree. Molecular beacon nucleic acid molecules are described, for example, in U.S. Pat. No. 5,876,930.

IV. ISOLATED PROTEINS AND ANTIBODIES

One aspect of the invention pertains to isolated proteins which correspond to individual markers of the invention, and biologically active portions thereof, as well as polypeptide fragments suitable for use as immunogens to raise antibodies directed against a polypeptide corresponding to a marker of the invention. In one embodiment, the native polypeptide corresponding to a marker can be isolated from cells or tissue sources by an appropriate purification scheme using standard protein purification techniques. In another embodiment, polypeptides corresponding to a marker of the invention are produced by recombinant DNA techniques. Alternative to recombinant expression, a polypeptide corresponding to a marker of the invention can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, 20%, 10%, or 5% (by dry weight) of heterologous protein (also referred to herein as a "contaminating protein"). When the protein or biologically active portion thereof is recombinantly produced, it is also preferably substantially free of culture medium, i.e., culture medium represents less than about 20%, 10%, or 5% of the volume of the protein preparation. When the protein is produced by chemical synthesis, it is preferably substantially free of chemical precursors or other chemicals, i.e., it is separated from chemical precursors or other chemicals which are involved in the synthesis of the protein. Accordingly such preparations of the protein have less than about 30%, 20%, 10%, 5% (by dry weight) of chemical precursors or compounds other than the polypeptide of interest.

Biologically active portions of a polypeptide corresponding to a marker of the invention include polypeptides comprising amino acid sequences sufficiently identical to or derived from the amino acid sequence of the protein corresponding to the marker (e.g., the protein encoded by the nucleic acid molecules listed in Tables 4 or 5), which include fewer amino acids than the full length protein, and exhibit at least one activity of the corresponding full-length protein. Typically, biologically active portions comprise a domain or motif with at least one activity of the corresponding protein. A biologically active portion of a protein of the invention can be a polypeptide which is, for example, 10, 25, 50, 100 or more amino acids in length. Moreover, other biologically active portions, in which other regions of the protein are deleted, can be prepared by recombinant techniques and evaluated for one or more of the functional activities of the native form of a polypeptide of the invention.

Preferred polypeptides have an amino acid sequence of a protein encoded by a nucleic acid molecule listed in Tables 4 or 5. Other useful proteins are substantially identical (e.g., at least about 40%, preferably 50%, 60%, 70%, 80%, 90%, 95%, or 99%) to one of these sequences and retain the functional activity of the protein of the corresponding naturally-occurring protein yet differ in amino acid sequence due to natural allelic variation or mutagenesis.

To determine the percent identity of two amino acid sequences or of two nucleic acids, the sequences are aligned for optimal comparison purposes (e.g., gaps can be introduced in the sequence of a first amino acid or nucleic acid sequence for optimal alignment with a second amino or nucleic acid sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

The determination of percent identity between two sequences can be accomplished using a mathematical algorithm. A preferred, non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J. Mol. Biol.* 215:403-410. BLAST nucleotide searches can be performed with the NBLAST program, score=100, wordlength=12 to obtain nucleotide sequences homologous to a nucleic acid molecules of the invention. BLAST protein searches can be performed with the XBLAST program, score=50, wordlength=3 to obtain amino acid sequences homologous to a protein molecules of the invention. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another preferred, non-limiting example of a mathematical algorithm utilized for the comparison of sequences is the algorithm of Myers and Miller, (1988) *Comput Appl Biosci*, 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

The invention also provides chimeric or fusion proteins corresponding to a marker of the invention. As used herein, a "chimeric protein" or "fusion protein" comprises all or part (preferably a biologically active part) of a polypeptide corresponding to a marker of the invention operably linked to a heterologous polypeptide (i.e., a polypeptide other than the polypeptide corresponding to the marker). Within the fusion protein, the term "operably linked" is intended to indicate that the polypeptide of the invention and the heterologous polypeptide are fused in-frame to each other. The heterologous polypeptide can be fused to the amino-terminus or the carboxyl-terminus of the polypeptide of the invention.

One useful fusion protein is a GST fusion protein in which a polypeptide corresponding to a marker of the invention is fused to the carboxyl terminus of GST sequences. Such fusion proteins can facilitate the purification of a recombinant polypeptide of the invention.

In another embodiment, the fusion protein contains a heterologous signal sequence at its amino terminus. For example, the native signal sequence of a polypeptide corresponding to a marker of the invention can be removed and replaced with a signal sequence from another protein. For example, the gp67 secretory sequence of the baculovirus envelope protein can be used as a heterologous signal sequence (Ausubel et al., ed., *Current Protocols in Molecular Biology*, John Wiley & Sons, NY, 1992). Other examples of eukaryotic heterologous signal sequences include the secretory sequences of melittin and human placental alkaline phosphatase (Stratagene; La Jolla, Calif.). In yet another example, useful prokaryotic heterologous signal sequences include the phoA secretory signal (Sambrook et al., supra) and the protein A secretory signal (Pharmacia Biotech; Piscataway, N.J.).

In yet another embodiment, the fusion protein is an immunoglobulin fusion protein in which all or part of a polypeptide corresponding to a marker of the invention is fused to sequences derived from a member of the immunoglobulin protein family. The immunoglobulin fusion proteins of the invention can be incorporated into pharmaceutical compositions and administered to a subject to inhibit an interaction between a ligand (soluble or membrane-bound) and a protein on the surface of a cell (receptor), to thereby suppress signal transduction in vivo. The immunoglobulin fusion protein can be used to affect the bioavailability of a cognate ligand of a polypeptide of the invention. Inhibition of ligand/receptor interaction can be useful therapeutically, both for treating proliferative and differentiative disorders and for modulating (e.g. promoting or inhibiting) cell survival. Moreover, the immunoglobulin fusion proteins of the invention can be used as immunogens to produce antibodies directed against a polypeptide of the invention in a subject, to purify ligands and in screening assays to identify molecules which inhibit the interaction of receptors with ligands.

Chimeric and fusion proteins of the invention can be produced by standard recombinant DNA techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see, e.g., Ausubel et al., supra). Moreover, many expression vectors are commercially available that already encode a fusion moiety (e.g., a GST polypeptide). A nucleic acid encoding a polypeptide of the invention can be cloned into such an expression vector such that the fusion moiety is linked in-frame to the polypeptide of the invention.

A signal sequence can be used to facilitate secretion and isolation of the secreted protein or other proteins of interest. Signal sequences are typically characterized by a core of hydrophobic amino acids which are generally cleaved from the mature protein during secretion in one or more cleavage events. Such signal peptides contain processing sites that allow cleavage of the signal sequence from the mature proteins as they pass through the secretory pathway. Thus, the invention pertains to the described polypeptides having a signal sequence, as well as to polypeptides from which the signal sequence has been proteolytically cleaved (i.e., the cleavage products). In one embodiment, a nucleic acid sequence encoding a signal sequence can be operably linked in an expression vector to a protein of interest, such as a protein which is ordinarily not secreted or is otherwise difficult to isolate. The signal sequence directs secretion of the protein, such as from a eukaryotic host into which the expression vector is transformed, and the signal sequence is subsequently or concurrently cleaved. The protein can then be readily purified from the extracellular medium by art recognized methods. Alternatively, the signal sequence can be linked to the protein of interest using a sequence which facilitates purification, such as with a GST domain.

The present invention also pertains to variants of the polypeptides corresponding to individual markers of the invention. Such variants have an altered amino acid sequence which can function as either agonists (mimetics) or as antagonists. Variants can be generated by mutagenesis, e.g., discrete point mutation or truncation. An agonist can retain substantially the same, or a subset, of the biological activities of the naturally occurring form of the protein. An antagonist of a protein can inhibit one or more of the activities of the naturally occurring form of the protein by, for example, competitively binding to a downstream or upstream member of a cellular signaling cascade which includes the protein of interest. Thus, specific biological effects can be elicited by treatment with a variant of limited function. Treatment of a subject with a variant having a subset of the biological activities of the naturally occurring form of the protein can have fewer side effects in a subject relative to treatment with the naturally occurring form of the protein.

Variants of a protein of the invention which function as either agonists (mimetics) or as antagonists can be identified by screening combinatorial libraries of mutants, e.g., truncation mutants, of the protein of the invention for agonist or antagonist activity. In one embodiment, a variegated library of variants is generated by combinatorial mutagenesis at the nucleic acid level and is encoded by a variegated gene library. A variegated library of variants can be produced by, for example, enzymatically ligating a mixture of synthetic oligonucleotides into gene sequences such that a degenerate set of potential protein sequences is expressible as individual polypeptides, or alternatively, as a set of larger fusion proteins (e.g., for phage display). There are a variety of methods which can be used to produce libraries of potential variants of the polypeptides of the invention from a degenerate oligonucleotide sequence. Methods for synthesizing degenerate oligonucleotides are known in the art (see, e.g., Narang, 1983, *Tetrahedron* 39:3; Itakura et al., 1984, *Annu. Rev. Biochem.* 53:323; Itakura et al., 1984, *Science* 198:1056; Ike et al., 1983 *Nucleic Acid Res.* 11:477).

In addition, libraries of fragments of the coding sequence of a polypeptide corresponding to a marker of the invention can be used to generate a variegated population of polypeptides for screening and subsequent selection of variants. For example, a library of coding sequence fragments can be generated by treating a double stranded PCR fragment of the coding sequence of interest with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes amino terminal and internal fragments of various sizes of the protein of interest.

Several techniques are known in the art for screening gene products of combinatorial libraries made by point mutations or truncation, and for screening cDNA libraries for gene products having a selected property. The most widely used techniques, which are amenable to high throughput analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of a protein of the invention (Arkin and Yourvan, 1992, *Proc. Natl. Acad. Sci. USA* 89:7811-7815; Delgrave et al., 1993, *Protein Engineering* 6(3):327-331).

An isolated polypeptide corresponding to a marker of the invention, or a fragment thereof, can be used as an immunogen to generate antibodies using standard techniques for polyclonal and monoclonal antibody preparation. The full-length polypeptide or protein can be used or, alternatively, the invention provides antigenic peptide fragments for use as immunogens. The antigenic peptide of a protein of the invention comprises at least 8 (preferably 10, 15, 20, or 30 or more) amino acid residues of the amino acid sequence of one of the polypeptides of the invention, and encompasses an epitope of the protein such that an antibody raised against the peptide forms a specific immune complex with a marker of the invention to which the protein corresponds. Preferred epitopes encompassed by the antigenic peptide are regions that are located on the surface of the protein, e.g., hydrophilic regions. Hydrophobicity sequence analysis, hydrophilicity sequence analysis, or similar analyses can be used to identify hydrophilic regions.

An immunogen typically is used to prepare antibodies by immunizing a suitable (i.e. immunocompetent) subject such as a rabbit, goat, mouse, or other mammal or vertebrate. An appropriate immunogenic preparation can contain, for example, recombinantly-expressed or chemically-synthesized polypeptide. The preparation can further include an adjuvant, such as Freund's complete or incomplete adjuvant, or a similar immunostimulatory agent.

Accordingly, another aspect of the invention pertains to antibodies directed against a polypeptide of the invention. The terms "antibody" and "antibody substance" as used interchangeably herein refer to immunoglobulin molecules and immunologically active portions of immunoglobulin molecules, i.e., molecules that contain an antigen binding site which specifically binds an antigen, such as a polypeptide of the invention. A molecule which specifically binds to a given polypeptide of the invention is a molecule which binds the polypeptide, but does not substantially bind other molecules in a sample, e.g., a biological sample, which naturally contains the polypeptide. Examples of immunologically active portions of immunoglobulin molecules include F(ab) and F(ab')$_2$ fragments which can be generated by treating the antibody with an enzyme such as pepsin. The invention provides polyclonal and monoclonal antibodies. The term "monoclonal antibody" or "monoclonal antibody composition", as used herein, refers to a population of antibody molecules that contain only one species of an antigen binding site capable of immunoreacting with a particular epitope.

Polyclonal antibodies can be prepared as described above by immunizing a suitable subject with a polypeptide of the invention as an immunogen. The antibody titer in the immunized subject can be monitored over time by standard techniques, such as with an enzyme linked immunosorbent assay (ELISA) using immobilized polypeptide. If desired, the antibody molecules can be harvested or isolated from the subject (e.g., from the blood or serum of the subject) and further purified by well-known techniques, such as protein A chromatography to obtain the IgG fraction. At an appropriate time after immunization, e.g., when the specific antibody titers are highest, antibody-producing cells can be obtained from the subject and used to prepare monoclonal antibodies by standard techniques, such as the hybridoma technique originally described by Kohler and Milstein (1975) Nature 256:495-497, the human B cell hybridoma technique (see Kozbor et al., 1983, Immunol. Today 4:72), the EBV-hybridoma technique (see Cole et al., pp. 77-96 In Monoclonal Antibodies and Cancer Therapy, Alan R. Liss, Inc., 1985) or trioma techniques. The technology for producing hybridomas is well known (see generally Current Protocols in Immunology, Coligan et al. ed., John Wiley & Sons, New York, 1994). Hybridoma cells producing a monoclonal antibody of the invention are detected by screening the hybridoma culture supernatants for antibodies that bind the polypeptide of interest, e.g., using a standard ELISA assay.

Alternative to preparing monoclonal antibody-secreting hybridomas, a monoclonal antibody directed against a polypeptide of the invention can be identified and isolated by screening a recombinant combinatorial immunoglobulin library (e.g., an antibody phage display library) with the polypeptide of interest. Kits for generating and screening phage display libraries are commercially available (e.g., the Pharmacia Recombinant Phage Antibody System, Catalog No. 27-9400-01; and the Stratagene SurfZAP Phage Display Kit, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) Bio/Technology 9:1370-1372; Hay et al. (1992) Hum. Antibod. Hybridomas 3:81-85; Huse et al. (1989) Science 246:1275-1281; Griffiths et al. (1993) EMBO J. 12:725-734.

Additionally, recombinant antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) Science 240:1041-1043; Liu et al. (1987) Proc. Natl. Acad. Sci. USA 84:3439-3443; Liu et al. (1987) J. Immunol. 139:3521-3526; Sun et al. (1987) Proc. Natl. Acad. Sci. USA 84:214-218; Nishimura et al. (1987) Cancer Res. 47:999-1005; Wood et al. (1985) Nature 314:446-449; and Shaw et al. (1988) J. Natl. Cancer Inst. 80:1553-1559); Morrison (1985) Science 229:1202-1207; Oi et al. (1986) Bio/Techniques 4:214; U.S. Pat. No. 5,225,539; Jones et al. (1986) Nature 321:552-525; Verhoeyan et al. (1988) Science 239:1534; and Beidler et al. (1988) J. Immunol. 141:4053-4060.

Completely human antibodies are particularly desirable for therapeutic treatment of human subjects. Such antibodies can be produced using transgenic mice which are incapable of expressing endogenous immunoglobulin heavy and light chains genes, but which can express human heavy and light chain genes. The transgenic mice are immunized in the normal fashion with a selected antigen, e.g., all or a portion of a polypeptide corresponding to a marker of the invention. Monoclonal antibodies directed against the antigen can be obtained using conventional hybridoma technology. The human immunoglobulin transgenes harbored by the transgenic mice rearrange during B cell differentiation, and subsequently undergo class switching and somatic mutation. Thus, using such a technique, it is possible to produce therapeutically useful IgG, IgA and IgE antibodies. For an overview of this technology for producing human antibodies, see Lonberg and Huszar (1995) Int. Rev. Immunol. 13:65-93). For a detailed discussion of this technology for producing human antibodies and human monoclonal antibodies and protocols for producing such antibodies, see, e.g., U.S. Pat. No. 5,625,126; U.S. Pat. No. 5,633,425; U.S. Pat. No. 5,569,825; U.S.

Pat. No. 5,661,016; and U.S. Pat. No. 5,545,806. In addition, companies such as Abgenix, Inc. (Freemont, Calif.), can be engaged to provide human antibodies directed against a selected antigen using technology similar to that described above.

Completely human antibodies which recognize a selected epitope can be generated using a technique referred to as "guided selection." In this approach a selected non-human monoclonal antibody, e.g., a murine antibody, is used to guide the selection of a completely human antibody recognizing the same epitope (Jespers et al., 1994, *Bio/technology* 12:899-903).

An antibody, antibody derivative, or fragment thereof, which specifically binds a marker of the invention which is overexpressed in cancer (e.g., a marker set forth in Tables 1 or 4), may be used to inhibit activity of a marker, e.g., a marker set forth in Tables 1 or 4, and therefore may be administered to a subject to treat, inhibit, or prevent cancer in the subject. Furthermore, conjugated antibodies may also be used to treat, inhibit, or prevent cancer in a subject. Conjugated antibodies, preferably monoclonal antibodies, or fragments thereof, are antibodies which are joined to drugs, toxins, or radioactive atoms, and used as delivery vehicles to deliver those substances directly to cancer cells. The antibody, e.g., an antibody which specifically binds a marker of the invention (e.g., a marker listed in Tables 1 or 4), is administered to a subject and binds the marker, thereby delivering the toxic substance to the cancer cell, minimizing damage to normal cells in other parts of the body.

Conjugated antibodies are also referred to as "tagged," "labeled," or "loaded." Antibodies with chemotherapeutic agents attached are generally referred to as chemolabeled. Antibodies with radioactive particles attached are referred to as radiolabeled, and this type of therapy is known as radioimmunotherapy (RIT). Aside from being used to treat cancer, radiolabeled antibodies can also be used to detect areas of cancer spread in the body. Antibodies attached to toxins are called immunotoxins.

Immunotoxins are made by attaching toxins (e.g., poisonous substances from plants or bacteria) to monoclonal antibodies. Immunotoxins may be produced by attaching monoclonal antibodies to bacterial toxins such as diphtherial toxin (DT) or pseudomonal exotoxin (PE40), or to plant toxins such as ricin A or saporin.

An antibody directed against a polypeptide corresponding to a marker of the invention (e.g., a monoclonal antibody) can be used to isolate the polypeptide by standard techniques, such as affinity chromatography or immunoprecipitation. Moreover, such an antibody can be used to detect the marker (e.g., in a cellular lysate or cell supernatant) in order to evaluate the level and pattern of expression of the marker. The antibodies can also be used diagnostically to monitor protein levels in tissues or body fluids (e.g. in a blood- or bone marrow-associated body fluid) as part of a clinical testing procedure, e.g., to, for example, determine the efficacy of a given treatment regimen. Detection can be facilitated by coupling the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

V. RECOMBINANT EXPRESSION VECTORS AND HOST CELLS

Another aspect of the invention pertains to vectors, preferably expression vectors, containing a nucleic acid encoding a polypeptide corresponding to a marker of the invention (or a portion of such a polypeptide). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, namely expression vectors, are capable of directing the expression of genes to which they are operably linked. In general, expression vectors of utility in recombinant DNA techniques are often in the form of plasmids (vectors). However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, *Methods in Enzymology: Gene Expression Technology* vol. 185, Academic Press, San Diego, Calif. (1991). Regulatory sequences include those which direct constitutive expression of a nucleotide sequence in many types of host cell and those which direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, and the like. The expression vectors of the invention can be introduced into host cells to thereby produce proteins or peptides, including fusion proteins or peptides, encoded by nucleic acids as described herein.

The recombinant expression vectors of the invention can be designed for expression of a polypeptide corresponding to a marker of the invention in prokaryotic (e.g., *E. coli*) or eukaryotic cells (e.g., insect cells {using baculovirus expression vectors}, yeast cells or mammalian cells). Suitable host cells are discussed further in Goeddel, supra. Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson, 1988, *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Examples of suitable inducible non-fusion *E. coli* expression vectors include pTrc (Amann et al., 1988, *Gene* 69:301-315) and pET 11d (Studier et al., p. 60-89, In *Gene Expression Technology: Methods in Enzymology* vol. 185, Academic Press, San Diego, Calif., 1991). Target gene expression from the pTrc vector relies on host RNA polymerase transcription from a hybrid trp-lac fusion promoter. Target gene expression from the pET 11d vector relies on transcription from a T7 gn 10-lac fusion promoter mediated by a co-expressed viral RNA polymerase (T7 gn1). This viral polymerase is supplied by host strains BL21 (DE3) or HMS174(DE3) from a resident prophage harboring a T7 gn1 gene under the transcriptional control of the lacUV 5 promoter.

One strategy to maximize recombinant protein expression in *E. coli* is to express the protein in a host bacterium with an impaired capacity to proteolytically cleave the recombinant protein (Gottesman, p. 119-128, In *Gene Expression Technology: Methods in Enzymology* vol. 185, Academic Press, San Diego, Calif., 1990. Another strategy is to alter the nucleic acid sequence of the nucleic acid to be inserted into an expression vector so that the individual codons for each amino acid are those preferentially utilized in *E. coli* (Wada et al., 1992, *Nucleic Acids Res.* 20:2111-2118). Such alteration of nucleic acid sequences of the invention can be carried out by standard DNA synthesis techniques.

In another embodiment, the expression vector is a yeast expression vector. Examples of vectors for expression in yeast *S. cerevisiae* include pYepSec1 (Baldari et al., 1987, *EMBO J.* 6:229-234), pMFa (Kurjan and Herskowitz, 1982, *Cell* 30:933-943), pJRY88 (Schultz et al., 1987, *Gene* 54:113-123), pYES2 (Invitrogen Corporation, San Diego, Calif.), and pPicZ (Invitrogen Corp, San Diego, Calif.).

Alternatively, the expression vector is a baculovirus expression vector. Baculovirus vectors available for expression of proteins in cultured insect cells (e.g., Sf 9 cells) include the pAc series (Smith et al., 1983, *Mol. Cell. Biol.* 3:2156-2165) and the pVL series (Lucklow and Summers, 1989, *Virology* 170:31-39).

In yet another embodiment, a nucleic acid of the invention is expressed in mammalian cells using a mammalian expression vector. Examples of mammalian expression vectors include pCDM8 (Seed, 1987, *Nature* 329:840) and pMT2PC (Kaufman et al., 1987, *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook et al., supra.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al., 1987, *Genes Dev.* 1:268-277), lymphoid-specific promoters (Calame and Eaton, 1988, *Adv. Immunol.* 43:235-275), in particular promoters of T cell receptors (Winoto and Baltimore, 1989, *EMBO J.* 8:729-733) and immunoglobulins (Banerji et al., 1983, *Cell* 33:729-740; Queen and Baltimore, 1983, *Cell* 33:741-748), neuron-specific promoters (e.g., the neurofilament promoter; Byrne and Ruddle, 1989, *Proc. Natl. Acad. Sci. USA* 86:5473-5477), pancreas-specific promoters (Edlund et al., 1985, *Science* 230:912-916), and mammary gland-specific promoters (e.g. milk whey promoter; U.S. Pat. No. 4,873,316 and European Application Publication No. 264,166). Developmentally-regulated promoters are also encompassed, for example the murine hox promoters (Kessel and Gruss, 1990, *Science* 249:374-379) and the α-fetoprotein promoter (Camper and Tilghman, 1989, *Genes Dev.* 3:537-546).

The invention further provides a recombinant expression vector comprising a DNA molecule of the invention cloned into the expression vector in an antisense orientation. That is, the DNA molecule is operably linked to a regulatory sequence in a manner which allows for expression (by transcription of the DNA molecule) of an RNA molecule which is antisense to the mRNA encoding a polypeptide of the invention. Regulatory sequences operably linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue-specific or cell type specific expression of antisense RNA. The antisense expression vector can be in the form of a recombinant plasmid, phagemid, or attenuated virus in which antisense nucleic acids are produced under the control of a high efficiency regulatory region, the activity of which can be determined by the cell type into which the vector is introduced. For a discussion of the regulation of gene expression using antisense genes see Weintraub et al., 1986, *Trends in Genetics*, Vol. 1(1).

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic (e.g., *E. coli*) or eukaryotic cell (e.g., insect cells, yeast or mammalian cells).

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die).

A host cell of the invention, such as a prokaryotic or eukaryotic host cell in culture, can be used to produce a polypeptide corresponding to a marker of the invention. Accordingly, the invention further provides methods for producing a polypeptide corresponding to a marker of the invention using the host cells of the invention. In one embodiment, the method comprises culturing the host cell of invention (into which a recombinant expression vector encoding a polypeptide of the invention has been introduced) in a suitable medium such that the marker is produced. In another embodiment, the method further comprises isolating the marker polypeptide from the medium or the host cell.

The host cells of the invention can also be used to produce nonhuman transgenic animals. For example, in one embodiment, a host cell of the invention is a fertilized oocyte or an embryonic stem cell into which sequences encoding a polypeptide corresponding to a marker of the invention have been introduced. Such host cells can then be used to create non-human transgenic animals in which exogenous sequences encoding a marker protein of the invention have been introduced into their genome or homologous recombinant animals in which endogenous gene(s) encoding a polypeptide corresponding to a marker of the invention sequences have been altered. Such animals are useful for studying the function and/or activity of the polypeptide corresponding to the marker, for identifying and/or evaluating modulators of polypeptide activity, as well as in pre-clinical testing of therapeutics or diagnostic molecules, for marker discovery or evaluation, e.g., therapeutic and diagnostic marker discovery or evaluation, or as surrogates of drug efficacy and specificity.

As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, etc. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, an "homologous recombinant animal" is a non-human animal, preferably a mammal, more preferably a mouse, in which an endogenous gene has been altered by homologous recombination between the endogenous gene and an exogenous DNA molecule introduced into a cell of the animal, e.g., an embryonic cell of the animal, prior to development of the animal. Transgenic animals also include inducible transgenic animals, such as those described in, for example, Chan I. T., et al. (2004) *J Clin Invest.* 113(4):528-38 and Chin L. et al (1999) *Nature* 400 (6743):468-72.

A transgenic animal of the invention can be created by introducing a nucleic acid encoding a polypeptide corresponding to a marker of the invention into the male pronuclei of a fertilized oocyte, e.g., by microinjection, retroviral infection, and allowing the oocyte to develop in a pseudopregnant female foster animal. Intronic sequences and polyadenylation signals can also be included in the transgene to increase the efficiency of expression of the transgene. A tissue-specific regulatory sequence(s) can be operably linked to the transgene to direct expression of the polypeptide of the invention to particular cells. Methods for generating transgenic animals via embryo manipulation and microinjection, particularly animals such as mice, have become conventional in the art and are described, for example, in U.S. Pat. Nos. 4,736,866 and 4,870,009, U.S. Pat. No. 4,873,191 and in Hogan, *Manipulating the Mouse Embryo*, Cold Spring Harbor Laboratory Press, Cold Spring Harbor, N.Y., 1986. Similar methods are used for production of other transgenic animals. A transgenic founder animal can be identified based upon the presence of the transgene in its genome and/or expression of mRNA encoding the transgene in tissues or cells of the animals. A transgenic founder animal can then be used to breed additional animals carrying the transgene. Moreover, transgenic animals carrying the transgene can further be bred to other transgenic animals carrying other transgenes.

To create an homologous recombinant animal, a vector is prepared which contains at least a portion of a gene encoding a polypeptide corresponding to a marker of the invention into which a deletion, addition or substitution has been introduced to thereby alter, e.g., functionally disrupt, the gene. In a preferred embodiment, the vector is designed such that, upon homologous recombination, the endogenous gene is functionally disrupted (i.e., no longer encodes a functional protein; also referred to as a "knock out" vector). Alternatively, the vector can be designed such that, upon homologous recombination, the endogenous gene is mutated or otherwise altered but still encodes functional protein (e.g., the upstream regulatory region can be altered to thereby alter the expression of the endogenous protein). In the homologous recombination vector, the altered portion of the gene is flanked at its 5' and 3' ends by additional nucleic acid of the gene to allow for homologous recombination to occur between the exogenous gene carried by the vector and an endogenous gene in an embryonic stem cell. The additional flanking nucleic acid sequences are of sufficient length for successful homologous recombination with the endogenous gene. Typically, several kilobases of flanking DNA (both at the 5' and 3' ends) are included in the vector (see, e.g., Thomas and Capecchi, 1987, *Cell* 51:503 for a description of homologous recombination vectors). The vector is introduced into an embryonic stem cell line (e.g., by electroporation) and cells in which the introduced gene has homologously recombined with the endogenous gene are selected (see, e.g., Li et al., 1992, *Cell* 69:915). The selected cells are then injected into a blastocyst of an animal (e.g., a mouse) to form aggregation chimeras (see, e.g., Bradley, *Teratocarcinomas and Embryonic Stem Cells: A Practical Approach*, Robertson, Ed., IRL, Oxford, 1987, pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley (1991) *Current Opinion in Bio/Technology* 2:823-829 and in PCT Publication NOS. WO 90/11354, WO 91/01140, WO 92/0968, and WO 93/04169.

In another embodiment, transgenic non-human animals can be produced which contain selected systems which allow for regulated expression of the transgene. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of *Saccharomyces cerevisiae* (O'Gorman et al., 1991, *Science* 251:1351-1355). If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut et al. (1997) *Nature* 385:810-813 and PCT Publication NOS. WO 97/07668 and WO 97/07669.

VI. METHODS OF TREATMENT

The present invention provides for both prophylactic and therapeutic methods of treating a subject, e.g., a human, who has or is at risk of (or susceptible to) cancer, e.g., B cell cancer, e.g., multiple myeloma, Waldenström's macroglobulinemia, the heavy chain diseases, such as, for example, alpha chain disease, gamma chain disease, and mu chain disease, benign monoclonal gammopathy, and immunocytic amyloidosis. As used herein, "treatment" of a subject includes the application or administration of a therapeutic agent to a subject, or application or administration of a therapeutic agent to a cell or tissue from a subject, who has a diseases or disorder, has a symptom of a disease or disorder, or is at risk of (or susceptible to) a disease or disorder, with the purpose of curing, inhibiting, healing, alleviating, relieving, altering, remedying, ameliorating, improving, or affecting the disease or disorder, the symptom of the disease or disorder, or the risk of (or susceptibility to) the disease or disorder. As used herein, a "therapeutic agent" or "compound" includes, but is not limited to, small molecules, peptides, peptidomimetics, polypeptides, RNA interfering agents, e.g., siRNA molecules, antibodies, ribozymes, and antisense oligonucleotides.

As described herein, cancer in subjects is associated with a change, e.g., an increase in the amount and/or activity, or a change in the structure, of one or more markers listed in Tables 1 or 4 (e.g., a marker that was shown to be increased in cancer), and/or a decrease in the amount and/or activity, or a change in the structure of one or more markers listed in Tables 2 or 5 (e.g., a marker that was shown to be decreased in cancer). While, as discussed above, some of these changes in amount, structure, and/or activity, result from occurrence of the cancer, others of these changes induce, maintain, and promote the cancerous state of cancer, cells. Thus, cancer, characterized by an increase in the amount and/or activity, or a change in the structure, of one or more markers listed in Tables 1 or 4 (e.g., a marker that is shown to be increased in cancer), can be inhibited by inhibiting amount, e.g., expression or protein level, and/or activity of those markers. Likewise, cancer characterized by a decrease in the amount and/or activity, or a change in the structure, of one or more markers listed in Tables 2 or 5 (e.g., a marker that is shown to be decreased in cancer), can be inhibited by enhancing amount, e.g., expression or protein level, and/or activity of those markers.

Accordingly, another aspect of the invention pertains to methods for treating a subject suffering from cancer. These methods involve administering to a subject a compound which modulates amount and/or activity of one or more markers of the invention. For example, methods of treatment or prevention of cancer include administering to a subject a compound which decreases the amount and/or activity of one or more markers listed in Tables 1 or 4 (e.g., a marker that was shown to be increased in cancer). Compounds, e.g., antagonists, which may be used to inhibit amount and/or activity of a marker listed in Tables 1 or 4, to thereby treat or prevent cancer include antibodies (e.g., conjugated antibodies), small molecules, RNA interfering agents, e.g., siRNA molecules, ribozymes, and antisense oligonucleotides. In one embodiment, an antibody used for treatment is conjugated to a toxin, a chemotherapeutic agent, or radioactive particles.

Methods of treatment or prevention of cancer also include administering to a subject a compound which increases the amount and/or activity of one or more markers listed in Tables 2 or 5 (e.g., a marker that was shown to be decreased in cancer). Compounds, e.g., agonists, which may be used to increase expression or activity of a marker listed in Tables 2 or 5, to thereby treat or prevent cancer include small molecules, peptides, peptoids, peptidomimetics, and polypeptides.

Small molecules used in the methods of the invention include those which inhibit a protein-protein interaction and thereby either increase or decrease marker amount and/or activity. Furthermore, modulators, e.g., small molecules, which cause re-expression of silenced genes, e.g., tumor suppressors, are also included herein. For example, such molecules include compounds which interfere with DNA binding or methyltransferase activity.

An aptamer may also be used to modulate, e.g., increase or inhibit expression or activity of a marker of the invention to thereby treat, prevent or inhibit cancer. Aptamers are DNA or RNA molecules that have been selected from random pools based on their ability to bind other molecules. Aptamers may be selected which bind nucleic acids or proteins.

VII. SCREENING ASSAYS

The invention also provides methods (also referred to herein as "screening assays") for identifying modulators, i.e., candidate or test compounds or agents (e.g., proteins, peptides, peptidomimetics, peptoids, small molecules or other drugs) which (a) bind to a marker of the invention, or (b) have a modulatory (e.g., stimulatory or inhibitory) effect on the activity of a marker of the invention or, more specifically, (c) have a modulatory effect on the interactions of a marker of the invention with one or more of its natural substrates (e.g., peptide, protein, hormone, co-factor, or nucleic acid), or (d) have a modulatory effect on the expression of a marker of the invention. Such assays typically comprise a reaction between the marker and one or more assay components. The other components may be either the test compound itself, or a combination of test compound and a natural binding partner of the marker. Compounds identified via assays such as those described herein may be useful, for example, for modulating, e.g., inhibiting, ameliorating, treating, or preventing cancer.

The test compounds of the present invention may be obtained from any available source, including systematic libraries of natural and/or synthetic compounds. Test compounds may also be obtained by any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al., 1994, *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam, 1997, *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckemmann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233. Libraries of compounds may be presented in solution (e.g., Houghten, 1992, *Biotechniques* 13:412-421), or on beads (Lam, 1991, *Nature* 354:82-84), chips (Fodor, 1993, *Nature* 364:555-556), bacteria and/or spores, (Ladner, U.S. Pat. No. 5,223,409), plasmids (Cull et al, 1992, *Proc Natl Acad Sci USA* 89:1865-1869) or on phage (Scott and Smith, 1990, *Science* 249:386-390; Devlin, 1990, *Science* 249:404-406; Cwirla et al, 1990, *Proc. Natl. Acad. Sci.* 87:6378-6382; Felici, 1991, *J. Mol. Biol.* 222:301-310; Ladner, supra.).

In one embodiment, the invention provides assays for screening candidate or test compounds which are substrates of a marker of the invention or biologically active portion thereof. In another embodiment, the invention provides assays for screening candidate or test compounds which bind to a marker of the invention or biologically active portion thereof. Determining the ability of the test compound to directly bind to a marker can be accomplished, for example, by coupling the compound with a radioisotope or enzymatic label such that binding of the compound to the marker can be determined by detecting the labeled marker compound in a complex. For example, compounds (e.g., marker substrates) can be labeled with $^{125}$I, $^{35}$S, $^{14}$C, or $^{3}$H, either directly or indirectly, and the radioisotope detected by direct counting of radioemission or by scintillation counting. Alternatively, assay components can be enzymatically labeled with, for example, horseradish peroxidase, alkaline phosphatase, or luciferase, and the enzymatic label detected by determination of conversion of an appropriate substrate to product.

In another embodiment, the invention provides assays for screening candidate or test compounds which modulate the activity of a marker of the invention or a biologically active portion thereof. In all likelihood, the marker can, in vivo, interact with one or more molecules, such as, but not limited to, peptides, proteins, hormones, cofactors and nucleic acids. For the purposes of this discussion, such cellular and extracellular molecules are referred to herein as "binding partners" or marker "substrate".

One necessary embodiment of the invention in order to facilitate such screening is the use of the marker to identify its natural in vivo binding partners. There are many ways to accomplish this which are known to one skilled in the art. One example is the use of the marker protein as "bait protein" in a two-hybrid assay or three-hybrid assay (see, e.g., U.S. Pat. No. 5,283,317; Zervos et al, 1993, *Cell* 72:223-232; Madura et al, 1993, *J. Biol. Chem.* 268:12046-12054; Bartel et al, 1993, *Biotechniques* 14:920-924; Iwabuchi et al, 1993 *Oncogene* 8:1693-1696; Brent WO94/10300) in order to identify other proteins which bind to or interact with the marker (binding partners) and, therefore, are possibly involved in the natural function of the marker. Such marker binding partners are also likely to be involved in the propagation of signals by the marker or downstream elements of a marker-mediated signaling pathway. Alternatively, such marker binding partners may also be found to be inhibitors of the marker.

The two-hybrid system is based on the modular nature of most transcription factors, which consist of separable DNA-binding and activation domains. Briefly, the assay utilizes two different DNA constructs. In one construct, the gene that encodes a marker protein fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a marker-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be readily detected and cell colonies containing the functional transcription factor can be isolated and used to obtain the cloned gene which encodes the protein which interacts with the marker protein.

In a further embodiment, assays may be devised through the use of the invention for the purpose of identifying compounds which modulate (e.g., affect either positively or negatively) interactions between a marker and its substrates and/or binding partners. Such compounds can include, but are not limited to, molecules such as antibodies, peptides, hormones, oligonucleotides, nucleic acids, and analogs thereof. Such compounds may also be obtained from any available source, including systematic libraries of natural and/or synthetic compounds. The preferred assay components for use in this embodiment is a cancer marker identified herein, the known binding partner and/or substrate of same, and the test compound. Test compounds can be supplied from any source.

The basic principle of the assay systems used to identify compounds that interfere with the interaction between the marker and its binding partner involves preparing a reaction mixture containing the marker and its binding partner under conditions and for a time sufficient to allow the two products to interact and bind, thus forming a complex. In order to test an agent for inhibitory activity, the reaction mixture is prepared in the presence and absence of the test compound. The test compound can be initially included in the reaction mixture, or can be added at a time subsequent to the addition of the marker and its binding partner. Control reaction mixtures are incubated without the test compound or with a placebo. The formation of any complexes between the marker and its binding partner is then detected. The formation of a complex in the control reaction, but less or no such formation in the reaction mixture containing the test compound, indicates that the compound interferes with the interaction of the marker and its binding partner. Conversely, the formation of more complex in the presence of compound than in the control reaction indicates that the compound may enhance interaction of the marker and its binding partner. The assay for compounds that interfere with the interaction of the marker with its binding partner may be conducted in a heterogeneous or homogeneous format. Heterogeneous assays involve anchoring either the marker or its binding partner onto a solid phase and detecting complexes anchored to the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction between the markers and the binding partners (e.g., by competition) can be identified by conducting the reaction in the presence of the test substance, i.e., by adding the test substance to the reaction mixture prior to or simultaneously with the marker and its interactive binding partner. Alternatively, test compounds that disrupt preformed complexes, e.g., compounds with higher binding constants that displace one of the components from the complex, can be tested by adding the test compound to the reaction mixture after complexes have been formed.

The various formats are briefly described below.

In a heterogeneous assay system, either the marker or its binding partner is anchored onto a solid surface or matrix, while the other corresponding non-anchored component may be labeled, either directly or indirectly. In practice, microtitre plates are often utilized for this approach. The anchored species can be immobilized by a number of methods, either non-covalent or covalent, that are typically well known to one who practices the art. Non-covalent attachment can often be accomplished simply by coating the solid surface with a solution of the marker or its binding partner and drying. Alternatively, an immobilized antibody specific for the assay component to be anchored can be used for this purpose. Such surfaces can often be prepared in advance and stored.

In related embodiments, a fusion protein can be provided which adds a domain that allows one or both of the assay components to be anchored to a matrix. For example, glutathione-S-transferase/marker fusion proteins or glutathione-S-transferase/binding partner can be adsorbed onto glutathione sepharose beads (Sigma Chemical, St. Louis, Mo.) or glutathione derivatized microtiter plates, which are then combined with the test compound or the test compound and either the non-adsorbed marker or its binding partner, and the mixture incubated under conditions conducive to complex formation (e.g., physiological conditions). Following incubation, the beads or microtiter plate wells are washed to remove any unbound assay components, the immobilized complex assessed either directly or indirectly, for example, as described above. Alternatively, the complexes can be dissociated from the matrix, and the level of marker binding or activity determined using standard techniques.

Other techniques for immobilizing proteins on matrices can also be used in the screening assays of the invention. For example, either a marker or a marker binding partner can be immobilized utilizing conjugation of biotin and streptavidin. Biotinylated marker protein or target molecules can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the protein-immobilized surfaces can be prepared in advance and stored.

In order to conduct the assay, the corresponding partner of the immobilized assay component is exposed to the coated surface with or without the test compound. After the reaction is complete, unreacted assay components are removed (e.g., by washing) and any complexes formed will remain immobilized on the solid surface. The detection of complexes anchored on the solid surface can be accomplished in a number of ways. Where the non-immobilized component is pre-labeled, the detection of label immobilized on the surface indicates that complexes were formed. Where the non-immobilized component is not pre-labeled, an indirect label can be used to detect complexes anchored on the surface; e.g., using a labeled antibody specific for the initially non-immobilized species (the antibody, in turn, can be directly labeled or indirectly labeled with, e.g., a labeled anti-Ig antibody). Depending upon the order of addition of reaction components, test compounds which modulate (inhibit or enhance) complex formation or which disrupt preformed complexes can be detected.

In an alternate embodiment of the invention, a homogeneous assay may be used. This is typically a reaction, analogous to those mentioned above, which is conducted in a liquid phase in the presence or absence of the test compound. The formed complexes are then separated from unreacted components, and the amount of complex formed is determined. As mentioned for heterogeneous assay systems, the order of addition of reactants to the liquid phase can yield information about which test compounds modulate (inhibit or enhance) complex formation and which disrupt preformed complexes.

In such a homogeneous assay, the reaction products may be separated from unreacted assay components by any of a number of standard techniques, including but not limited to: differential centrifugation, chromatography, electrophoresis and immunoprecipitation. In differential centrifugation, complexes of molecules may be separated from uncomplexed molecules through a series of centrifugal steps, due to the different sedimentation equilibria of complexes based on their different sizes and densities (see, for example, Rivas, G., and Minton, A. P., *Trends Biochem Sci* 1993 August; 18(8): 284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the complex as compared to the uncomplexed molecules may be exploited to differentially separate the complex from the remaining individual reactants, for example through the use of ion-exchange chromatography resins. Such resins and chromatographic techniques are well known to one skilled in the art (see, e.g., Heegaard, 1998, *J. Mol. Recognit.* 11:141-148; Hage and Tweed, 1997, *J. Chromatogr. B. Biomed. Sci. Appl.*, 699:499-525). Gel electrophoresis may also be employed to separate complexed molecules from unbound species (see, e.g., Ausubel et al (eds.), In: *Current Protocols in Molecular Biology*, J. Wiley & Sons, New York. 1999). In this technique, protein or nucleic acid complexes are separated based on size or charge, for example. In order to maintain the binding interaction during the electrophoretic process, nondenaturing gels in the absence of reducing agent are typically preferred, but conditions appropriate to the particular interactants will be well known to one skilled in the art. Immunoprecipitation is another common technique utilized for the isolation of a protein-protein complex from solution (see, e.g., Ausubel et al (eds.), In: *Current Protocols in Molecular Biology*, J. Wiley & Sons, New York. 1999). In this technique, all proteins binding to an antibody specific to one of the binding molecules are precipitated from solution by conjugating the antibody to a polymer bead that may be readily collected by centrifugation. The bound assay components are released from the beads (through a specific proteolysis event or other technique well known in the art which will not disturb the protein-protein interaction in the complex), and a second immunoprecipitation step is performed, this time utilizing antibodies specific for the correspondingly different interacting assay component. In this manner, only formed complexes should remain attached to the beads. Variations in complex formation in both the presence and the absence of a test compound can be compared, thus offering information about the ability of the compound to modulate interactions between the marker and its binding partner.

Also within the scope of the present invention are methods for direct detection of interactions between the marker and its natural binding partner and/or a test compound in a homogeneous or heterogeneous assay system without further sample manipulation. For example, the technique of fluorescence energy transfer may be utilized (see, e.g., Lakowicz et al, U.S. Pat. No. 5,631,169; Stavrianopoulos et al, U.S. Pat. No. 4,868,103). Generally, this technique involves the addition of a fluorophore label on a first 'donor' molecule (e.g., marker or test compound) such that its emitted fluorescent energy will be absorbed by a fluorescent label on a second, 'acceptor' molecule (e.g., marker or test compound), which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter). A test substance which either enhances or hinders participation of one of the species in the preformed complex will result in the generation of a signal variant to that of background. In this way, test substances that modulate interactions between a marker and its binding partner can be identified in controlled assays. In another embodiment, modulators of marker expression are identified in a method wherein a cell is contacted with a candidate compound and the expression of mRNA or protein, corresponding to a marker in the cell, is determined. The level of expression of mRNA or protein in the presence of the candidate compound is compared to the level of expression of mRNA or protein in the absence of the candidate compound. The candidate compound can then be identified as a modulator of marker expression based on this comparison. For example, when expression of marker mRNA or protein is greater (statistically significantly greater) in the presence of the candidate compound than in its absence, the candidate compound is identified as a stimulator of marker mRNA or protein expression. Conversely, when expression of marker mRNA or protein is less (statistically significantly less) in the presence of the candidate compound than in its absence, the candidate compound is identified as an inhibitor of marker mRNA or protein expression. The level of marker mRNA or protein expression in the cells can be determined by methods described herein for detecting marker mRNA or protein.

In another aspect, the invention pertains to a combination of two or more of the assays described herein. For example, a modulating agent can be identified using a cell-based or a cell free assay, and the ability of the agent to modulate the activity of a marker protein can be further confirmed in vivo, e.g., in a whole animal model for cancer, cellular transformation and/or tumorigenesis. An animal model for B cell cancer is described in, for example, Miyakawa, Y, et al. (2004) *Biochem Biophys Res Commun.* 313:258-62, the contents of which are expressly incorporated herein by reference. Additional animal based models of cancer are well known in the art (reviewed in Animal Models of Cancer Predisposition Syndromes, Hiai, H and Hino, O (eds.) 1999, *Progress in Experimental Tumor Research, Vol.* 35; Clarke A R *Carcinogenesis* (2000) 21:435-41) and include, for example, carcinogen-induced tumors (Rithidech, K et al. *Mutat Res* (1999) 428:33-39; Miller, M L et al. *Environ Mol Mutagen* (2000) 35:319-327), injection and/or transplantation of tumor cells into an animal, as well as animals bearing mutations in growth regulatory genes, for example, oncogenes (e.g., ras) (Arbeit, J M et al. *Am J Pathol* (1993) 142:1187-1197; Sinn, E et al. *Cell* (1987) 49:465-475; Thorgeirsson, S S et al. *Toxicol Lett* (2000) 112-113:553-555) and tumor suppressor genes (e.g., p53) (Vooijs, M et al. Oncogene (1999) 18:5293-5303; Clark A R *Cancer Metast Rev* (1995) 14:125-148; Kumar, T R et al. *J Intern Med* (1995) 238:233-238; Donehower, L A et al. (1992) *Nature* 356215-221). Furthermore, experimental model systems are available for the study of, for example, ovarian cancer (Hamilton, T C et al. *Semin Oncol* (1984) 11:285-298; Rahman, N A et al. *Mol Cell Endocrinol* (1998) 145:167-174; Beamer, W G et al. *Toxicol Pathol* (1998) 26:704-710), gastric cancer (Thompson, J et al. *Int J Cancer* (2000) 86:863-869; Fodde, R et al. *Cytogenet Cell Genet* (1999) 86:105-111), breast cancer (Li, M et al. *Oncogene* (2000) 19:1010-1019; Green, J E et al. *Oncogene* (2000) 19:1020-1027), melanoma (Satyamoorthy, K et al. *Cancer Metast Rev* (1999) 18:401-405), and prostate cancer (Shirai, T et al. *Mutat Res* (2000) 462:219-226; Bostwick, D G et al. *Prostate* (2000) 43:286-294). Animal models described in, for example, Chin L. et al (1999) *Nature* 400(6743):468-72, may also be used in the methods of the invention.

This invention further pertains to novel agents identified by the above-described screening assays. Accordingly, it is within the scope of this invention to further use an agent identified as described herein in an appropriate animal model. For example, an agent identified as described herein (e.g., a marker modulating agent, a small molecule, an antisense marker nucleic acid molecule, a ribozyme, a marker-specific antibody, or fragment thereof, a marker protein, a marker nucleic acid molecule, an RNA interfering agent, e.g., an siRNA molecule targeting a marker of the invention, or a marker-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

VIII. PHARMACEUTICAL COMPOSITIONS

The small molecules, peptides, peptoids, peptidomimetics, polypeptides, RNA interfering agents, e.g., siRNA molecules, antibodies, ribozymes, and antisense oligonucleotides (also referred to herein as "active compounds" or "compounds") corresponding to a marker of the invention can be incorporated into pharmaceutical compositions suitable for administration. Such compositions typically comprise the small molecules, peptides, peptoids, peptidomimetics, polypeptides, RNA interfering agents, e.g., siRNA molecules, antibodies, ribozymes, or antisense oligonucleotides and a pharmaceutically acceptable carrier. As used herein the language "pharmaceutically acceptable carrier" is intended to include any and all solvents, dispersion media, coatings, antibacterial and antifungal agents, isotonic and absorption delaying agents, and the like, compatible with pharmaceutical administration. The use of such media and agents for pharmaceutically active substances is well known in the art. Except insofar as any conventional media or agent is incompatible with the active compound, use thereof in the compositions is contemplated. Supplementary active compounds can also be incorporated into the compositions.

The invention includes methods for preparing pharmaceutical compositions for modulating the expression or activity of a polypeptide or nucleic acid corresponding to a marker of the invention. Such methods comprise formulating a pharmaceutically acceptable carrier with an agent which modulates expression or activity of a polypeptide or nucleic acid corresponding to a marker of the invention. Such compositions can further include additional active agents. Thus, the invention further includes methods for preparing a pharmaceutical composition by formulating a pharmaceutically acceptable carrier with an agent which modulates expression or activity of a polypeptide or nucleic acid corresponding to a marker of the invention and one or more additional active compounds.

It is understood that appropriate doses of small molecule agents and protein or polypeptide agents depends upon a number of factors within the knowledge of the ordinarily skilled physician, veterinarian, or researcher. The dose(s) of these agents will vary, for example, depending upon the identity, size, and condition of the subject or sample being treated, further depending upon the route by which the composition is to be administered, if applicable, and the effect which the practitioner desires the agent to have upon the nucleic acid molecule or polypeptide of the invention. Small molecules include, but are not limited to, peptides, peptidomimetics, amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

Exemplary doses of a small molecule include milligram or microgram amounts per kilogram of subject or sample weight (e.g. about 1 microgram per kilogram to about 500 milligrams per kilogram, about 100 micrograms per kilogram to about 5 milligrams per kilogram, or about 1 microgram per kilogram to about 50 micrograms per kilogram).

As defined herein, a therapeutically effective amount of an RNA interfering agent, e.g., siRNA, (i.e., an effective dosage) ranges from about 0.001 to 3,000 mg/kg body weight, preferably about 0.01 to 2500 mg/kg body weight, more preferably about 0.1 to 2000, about 0.1 to 1000 mg/kg body weight, 0.1 to 500 mg/kg body weight, 0.1 to 100 mg/kg body weight, 0.1 to 50 mg/kg body weight, 0.1 to 25 mg/kg body weight, and even more preferably about 1 to 10 mg/kg, 2 to 9 mg/kg, 3 to 8 mg/kg, 4 to 7 mg/kg, or 5 to 6 mg/kg body weight. Treatment of a subject with a therapeutically effective amount of an RNA interfering agent can include a single treatment or, preferably, can include a series of treatments. In a preferred example, a subject is treated with an RNA interfering agent in the range of between about 0.1 to 20 mg/kg body weight, one time per week for between about 1 to 10 weeks, preferably between 2 to 8 weeks, more preferably between about 3 to 7 weeks, and even more preferably for about 4, 5, or 6 weeks.

Exemplary doses of a protein or polypeptide include gram, milligram or microgram amounts per kilogram of subject or sample weight (e.g. about 1 microgram per kilogram to about 5 grams per kilogram, about 100 micrograms per kilogram to about 500 milligrams per kilogram, or about 1 milligram per kilogram to about 50 milligrams per kilogram). It is furthermore understood that appropriate doses of one of these agents depend upon the potency of the agent with respect to the expression or activity to be modulated. Such appropriate doses can be determined using the assays described herein. When one or more of these agents is to be administered to an animal (e.g. a human) in order to modulate expression or activity of a polypeptide or nucleic acid of the invention, a physician, veterinarian, or researcher can, for example, prescribe a relatively low dose at first, subsequently increasing the dose until an appropriate response is obtained. In addition, it is understood that the specific dose level for any particular animal subject will depend upon a variety of factors including the activity of the specific agent employed, the age, body weight, general health, gender, and diet of the subject, the time of administration, the route of administration, the rate of excretion, any drug combination, and the degree of expression or activity to be modulated.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediamine-tetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor EL (BASF; Parsippany, N.J.) or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, or sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound (e.g., a polypeptide or antibody) in the required amount in an appropriate solvent with one or a combination of ingredients enumerated above, as required, followed by filtered sterilization. Generally, dispersions are prepared by incorporating the active compound into a sterile vehicle which contains a basic dispersion medium, and then incorporating the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed.

Pharmaceutically compatible binding agents, and/or adjuvant materials can be included as part of the composition. The tablets, pills, capsules, troches, and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from a pressurized container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes having monoclonal antibodies incorporated therein or thereon) can also be used as pharmaceutically acceptable carriers. These can be prepared according to methods known to those skilled in the art, for example, as described in U.S. Pat. No. 4,522,811.

It is especially advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

For antibodies, the preferred dosage is 0.1 mg/kg to 100 mg/kg of body weight (generally 10 mg/kg to 20 mg/kg). If the antibody is to act in the brain, a dosage of 50 mg/kg to 100 mg/kg is usually appropriate. Generally, partially human antibodies and fully human antibodies have a longer half-life within the human body than other antibodies. Accordingly, lower-dosages and less frequent administration is often possible. Modifications such as lipidation can be used to stabilize antibodies and to enhance uptake and tissue penetration (e.g., into the epithelium). A method for lipidation of antibodies is described by Cruikshank et al. (1997) *J. Acquired Immune Deficiency Syndromes and Human Retrovirology* 14:193.

The nucleic acid molecules corresponding to a marker of the invention can be inserted into vectors and used as gene therapy vectors. Gene therapy vectors can be delivered to a subject by, for example, intravenous injection, local administration (U.S. Pat. No. 5,328,470), or by stereotactic injection (see, e.g., Chen et al., 1994, *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g. retroviral vectors, the pharmaceutical preparation can include one or more cells which produce the gene delivery system.

The RNA interfering agents, e.g., siRNAs used in the methods of the invention can be inserted into vectors. These constructs can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054-3057). The pharmaceutical preparation of the vector can include the RNA interfering agent, e.g., the siRNA vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The pharmaceutical compositions can be included in a container, pack, or dispenser together with instructions for administration.

IX. PREDICTIVE MEDICINE

The present invention also pertains to the field of predictive medicine in which diagnostic assays, prognostic assays, pharmacogenomics, and monitoring clinical trails are used for prognostic (predictive) purposes to thereby treat an individual prophylactically. Accordingly, one aspect of the present invention relates to diagnostic assays for determining the amount, structure, and/or activity of polypeptides or nucleic acids corresponding to one or more markers of the invention, in order to determine whether an individual is at risk of developing cancer. Such assays can be used for prognostic or predictive purposes to thereby prophylactically treat an individual prior to the onset of the cancer.

Yet another aspect of the invention pertains to monitoring the influence of agents (e.g., drugs or other compounds administered either to inhibit cancer or to treat or prevent any other disorder {i.e. in order to understand any carcinogenic effects that such treatment may have}) on the amount, structure, and/or activity of a marker of the invention in clinical trials. These and other agents are described in further detail in the following sections.

A. Diagnostic Assays

1. Methods for Detection of Copy Number

Methods of evaluating the copy number of a particular marker or chromosomal region (e.g., an MCR) are well known to those of skill in the art. The presence or absence of chromosomal gain or loss can be evaluated simply by a determination of copy number of the regions or markers identified herein.

Methods for evaluating copy number of encoding nucleic acid in a sample include, but are not limited to, hybridization-based assays. For example, one method for evaluating the copy number of encoding nucleic acid in a sample involves a Southern Blot. In a Southern Blot, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., a non-amplified portion of the same or related cell, tissue, organ, etc.) provides an estimate of the relative copy number of the target nucleic acid. Alternatively, a Northern blot may be utilized for evaluating the copy number of encoding nucleic acid in a sample. In a Northern blot, mRNA is hybridized to a probe specific for the target region. Comparison of the intensity of the hybridization signal from the probe for the target region with control probe signal from analysis of normal mRNA (e.g., a non-amplified portion of the same or related cell, tissue, organ, etc.) provides an estimate of the relative copy number of the target nucleic acid.

An alternative means for determining the copy number is in situ hybridization (e.g., Angerer (1987) Meth. Enzymol 152: 649). Generally, in situ hybridization comprises the following steps: (1) fixation of tissue or biological structure to be analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application.

Preferred hybridization-based assays include, but are not limited to, traditional "direct probe" methods such as Southern blots or in situ hybridization (e.g., FISH and FISH plus SKY), and "comparative probe" methods such as comparative genomic hybridization (CGH), e.g., cDNA-based or oligonucleotide-based CGH. The methods can be used in a wide variety of formats including, but not limited to, substrate (e.g. membrane or glass) bound methods or array-based approaches.

In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained.

The probes are typically labeled, e.g., with radioisotopes or fluorescent reporters. Preferred probes are sufficiently long so as to specifically hybridize with the target nucleic acid(s) under stringent conditions. The preferred size range is from about 200 bases to about 1000 bases.

In some applications it is necessary to block the hybridization capacity of repetitive sequences. Thus, in some embodiments, tRNA, human genomic DNA, or Cot-I DNA is used to block non-specific hybridization.

In CGH methods, a first collection of nucleic acids (e.g., from a sample, e.g., a possible tumor) is labeled with a first label, while a second collection of nucleic acids (e.g., a control, e.g., from a healthy cell/tissue) is labeled with a second label. The ratio of hybridization of the nucleic acids is determined by the ratio of the two (first and second) labels binding to each fiber in the array. Where there are chromosomal deletions or multiplications, differences in the ratio of the signals from the two labels will be detected and the ratio will provide a measure of the copy number. Array-based CGH may also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays.

Hybridization protocols suitable for use with the methods of the invention are described, e.g., in Albertson (1984) *EMBO J.* 3: 1227-1234; Pinkel (1988) *Proc. Natl. Acad. Sci. USA* 85: 9138-9142; EPO Pub. No. 430,402; *Methods in Molecular Biology, Vol.* 33: In situ Hybridization Protocols, Choo, ed., Humana Press, Totowa, N.J. (1994), etc. In one embodiment, the hybridization protocol of Pinkel, et al. (1998) *Nature Genetics* 20: 207-211, or of Kallioniemi (1992) *Proc. Natl. Acad Sci USA* 89:5321-5325 (1992) is used.

The methods of the invention are particularly well suited to array-based hybridization formats. Array-based CGH is described in U.S. Pat. No. 6,455,258, the contents of which are incorporated herein by reference.

In still another embodiment, amplification-based assays can be used to measure copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g. healthy tissue, provides a measure of the copy number.

Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. Detailed protocols for quantitative PCR are provided in Innis, et al. (1990) PCR Protocols, *A Guide to Methods and Applications*, Academic Press, Inc. N.Y.). Measurement of DNA copy number at microsatellite loci using quantitative PCR anlaysis is described in Ginzonger, et al. (2000) *Cancer Research* 60:5405-5409. The known nucleic acid sequence for the genes is sufficient to enable one of skill in the art to routinely select primers to amplify any portion of the gene. Fluorogenic quantitative PCR may also be used in the methods of the invention. In fluorogenic quantitative PCR, quantitation is based on amount of fluorescence signals, e.g., TaqMan and sybr green.

Other suitable amplification methods include, but are not limited to, ligase chain reaction (LCR) (see Wu and Wallace (1989) *Genomics* 4: 560, Landegren, et al. (1988) *Science* 241:1077, and Barringer et al. (1990) *Gene* 89: 117), transcription amplification (Kwoh, et al. (1989) *Proc. Natl. Acad. Sci. USA* 86: 1173), self-sustained sequence replication (Guatelli, et al. (1990) *Proc. Nat. Acad. Sci. USA* 87: 1874), dot PCR, and linker adapter PCR, etc.

Loss of heterozygosity (LOH) mapping (Wang, Z. C., et al. (2004) *Cancer Res* 64(1):64-71; Seymour, A. B., et al. (1994) *Cancer Res* 54, 2761-4; Hahn, S. A., et al. (1995) *Cancer Res* 55, 4670-5; Kimura, M., et al. (1996) *Genes Chromosomes Cancer* 17, 88-93) may also be used to identify regions of amplification or deletion.

2. Methods for Detection of Gene Expression

Marker expression level can also be assayed as a method for diagnosis of cancer or risk for developing cancer. Expression of a marker of the invention may be assessed by any of a wide variety of well known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In preferred embodiments, activity of a particular gene is characterized by a measure of gene transcript (e.g. mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

Methods of detecting and/or quantifying the gene transcript (mRNA or cDNA made therefrom) using nucleic acid hybridization techniques are known to those of skill in the art (see Sambrook et al. supra). For example, one method for evaluating the presence, absence, or quantity of cDNA involves a Southern transfer as described above. Briefly, the mRNA is isolated (e.g. using an acid guanidinium-phenol-chloroform extraction method, Sambrook et al. supra.) and reverse transcribed to produce cDNA. The cDNA is then optionally digested and run on a gel in buffer and transferred to membranes. Hybridization is then carried out using the nucleic acid probes specific for the target cDNA.

A general principle of such diagnostic and prognostic assays involves preparing a sample or reaction mixture that may contain a marker, and a probe, under appropriate conditions and for a time sufficient to allow the marker and probe to interact and bind, thus forming a complex that can be removed and/or detected in the reaction mixture. These assays can be conducted in a variety of ways.

For example, one method to conduct such an assay would involve anchoring the marker or probe onto a solid phase support, also referred to as a substrate, and detecting target marker/probe complexes anchored on the solid phase at the end of the reaction. In one embodiment of such a method, a sample from a subject, which is to be assayed for presence and/or concentration of marker, can be anchored onto a carrier or solid phase support. In another embodiment, the reverse situation is possible, in which the probe can be anchored to a solid phase and a sample from a subject can be allowed to react as an unanchored component of the assay.

There are many established methods for anchoring assay components to a solid phase. These include, without limitation, marker or probe molecules which are immobilized through conjugation of biotin and streptavidin. Such biotinylated assay components can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical). In certain embodiments, the surfaces with immobilized assay components can be prepared in advance and stored.

Other suitable carriers or solid phase supports for such assays include any material capable of binding the class of molecule to which the marker or probe belongs. Well-known supports or carriers include, but are not limited to, glass, polystyrene, nylon, polypropylene, polyethylene, dextran, amylases, natural and modified celluloses, polyacrylamides, gabbros, and magnetite.

In order to conduct assays with the above-mentioned approaches, the non-immobilized component is added to the solid phase upon which the second component is anchored. After the reaction is complete, uncomplexed components may be removed (e.g., by washing) under conditions such that any complexes formed will remain immobilized upon the solid phase. The detection of marker/probe complexes anchored to the solid phase can be accomplished in a number of methods outlined herein.

In a preferred embodiment, the probe, when it is the unanchored assay component, can be labeled for the purpose of detection and readout of the assay, either directly or indirectly, with detectable labels discussed herein and which are well-known to one skilled in the art.

It is also possible to directly detect marker/probe complex formation without further manipulation or labeling of either component (marker or probe), for example by utilizing the technique of fluorescence energy transfer (see, for example, Lakowicz et al., U.S. Pat. No. 5,631,169; Stavrianopoulos, et al., U.S. Pat. No. 4,868,103). A fluorophore label on the first, 'donor' molecule is selected such that, upon excitation with incident light of appropriate wavelength, its emitted fluorescent energy will be absorbed by a fluorescent label on a second 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, spatial relationships between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determination of the ability of a probe to recognize a marker can be accomplished without labeling either assay component (probe or marker) by utilizing a technology such as real-time Biomolecular Interaction Analysis (BIA) (see, e.g., Sjolander, S, and Urbaniczky, C., 1991, *Anal. Chem.* 63:2338-2345 and Szabo et al., 1995, *Curr. Opin. Struct. Biol.* 5:699-705). As used herein, "BIA" or "surface plasmon resonance" is a technology for studying biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Alternatively, in another embodiment, analogous diagnostic and prognostic assays can be conducted with marker and probe as solutes in a liquid phase. In such an assay, the complexed marker and probe are separated from uncomplexed components by any of a number of standard techniques, including but not limited to: differential centrifugation, chromatography, electrophoresis and immunoprecipitation. In differential centrifugation, marker/probe complexes may be separated from uncomplexed assay components through a series of centrifugal steps, due to the different sedimentation equilibria of complexes based on their different sizes and densities (see, for example, Rivas, G., and Minton, A. P., 1993, *Trends Biochem Sci.* 18(8):284-7). Standard chromatographic techniques may also be utilized to separate complexed molecules from uncomplexed ones. For example, gel filtration chromatography separates molecules based on size, and through the utilization of an appropriate gel filtration resin in a column format, for example, the relatively larger complex may be separated from the relatively smaller uncomplexed components. Similarly, the relatively different charge properties of the marker/probe complex as compared to the uncomplexed components may be exploited to differentiate the complex from uncomplexed components, for example, through the utilization of ion-exchange chromatography resins. Such resins and chromatographic techniques are well known to one skilled in the art (see, e.g., Heegaard, N. H., 1998, *J. Mol. Recognit.* Winter 11(1-6):141-8; Hage, D. S., and Tweed, S. A. *J Chromatogr B Biomed Sci Appl* 1997 Oct. 10; 699(1-2):499-525). Gel electrophoresis may also be employed to separate complexed assay components from unbound components (see, e.g., Ausubel et al., ed., *Current Protocols in Molecular Biology*, John Wiley & Sons, New York, 1987-1999). In this technique, protein or nucleic acid complexes are separated based on size or charge, for example. In order to maintain the binding interaction during the electrophoretic process, non-denaturing gel matrix materials and conditions in the absence of reducing agent are typically preferred. Appropriate conditions to the particular assay and components thereof will be well known to one skilled in the art.

In a particular embodiment, the level of mRNA corresponding to the marker can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., *Current Protocols in Molecular Biology*, John Wiley & Sons, New York 1987-1999). Additionally, large numbers of tissue samples can readily be processed using techniques well known to those of skill in the art, such as, for example, the single-step RNA isolation process of Chomczynski (1989, U.S. Pat. No. 4,843,155).

The isolated nucleic acid can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding a marker of the present invention. Other suitable probes for use in the diagnostic assays of the invention are described herein. Hybridization of an mRNA with the probe indicates that the marker in question is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in an Affymetrix gene chip array. A skilled artisan can readily adapt known mRNA detection methods for use in detecting the level of mRNA encoded by the markers of the present invention.

The probes can be full length or less than the full length of the nucleic acid sequence encoding the protein. Shorter probes are empirically tested for specificity. Preferably nucleic acid probes are 20 bases or longer in length. (See, e.g., Sambrook et al. for methods of selecting nucleic acid probe sequences for use in nucleic acid hybridization.) Visualization of the hybridized portions allows the qualitative determination of the presence or absence of cDNA.

An alternative method for determining the level of a transcript corresponding to a marker of the present invention in a sample involves the process of nucleic acid amplification, e.g., by rtPCR (the experimental embodiment set forth in Mullis, 1987, U.S. Pat. No. 4,683,202), ligase chain reaction (Barany, 1991, *Proc. Natl. Acad. Sci. USA,* 88:189-193), self sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. Fluorogenic rtPCR may also be used in the methods of the invention. In fluorogenic rtPCR, quantitation is based on amount of fluorescence signals, e.g., TaqMan and sybr green. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the cells prior to detection. In such methods, a cell or tissue sample is prepared/processed using known histological methods. The sample is then immobilized on a support, typically a glass slide, and then contacted with a probe that can hybridize to mRNA that encodes the marker.

As an alternative to making determinations based on the absolute expression level of the marker, determinations may be based on the normalized expression level of the marker. Expression levels are normalized by correcting the absolute expression level of a marker by comparing its expression to the expression of a gene that is not a marker, e.g., a housekeeping gene that is constitutively expressed. Suitable genes for normalization include housekeeping genes such as the actin gene, or epithelial cell-specific genes. This normalization allows the comparison of the expression level in one sample, e.g., a subject sample, to another sample, e.g., a non-cancerous sample, or between samples from different sources.

Alternatively, the expression level can be provided as a relative expression level. To determine a relative expression level of a marker, the level of expression of the marker is determined for 10 or more samples of normal versus cancer cell isolates, preferably 50 or more samples, prior to the determination of the expression level for the sample in question. The mean expression level of each of the genes assayed in the larger number of samples is determined and this is used as a baseline expression level for the marker. The expression level of the marker determined for the test sample (absolute level of expression) is then divided by the mean expression value obtained for that marker. This provides a relative expression level.

Preferably, the samples used in the baseline determination will be from cancer cells or normal cells of the same tissue type. The choice of the cell source is dependent on the use of the relative expression level. Using expression found in normal tissues as a mean expression score aids in validating whether the marker assayed is specific to the tissue from which the cell was derived (versus normal cells). In addition, as more data is accumulated, the mean expression value can be revised, providing improved relative expression values based on accumulated data. Expression data from normal cells provides a means for grading the severity of the cancer state.

In another preferred embodiment, expression of a marker is assessed by preparing genomic DNA or mRNA/cDNA (i.e. a transcribed polynucleotide) from cells in a subject sample, and by hybridizing the genomic DNA or mRNA/cDNA with a reference polynucleotide which is a complement of a polynucleotide comprising the marker, and fragments thereof. cDNA can, optionally, be amplified using any of a variety of polymerase chain reaction methods prior to hybridization with the reference polynucleotide. Expression of one or more markers can likewise be detected using quantitative PCR (QPCR) to assess the level of expression of the marker(s). Alternatively, any of the many known methods of detecting mutations or variants (e.g. single nucleotide polymorphisms, deletions, etc.) of a marker of the invention may be used to detect occurrence of a mutated marker in a subject.

In a related embodiment, a mixture of transcribed polynucleotides obtained from the sample is contacted with a substrate having fixed thereto a polynucleotide complementary to or homologous with at least a portion (e.g. at least 7, 10, 15, 20, 25, 30, 40, 50, 100, 500, or more nucleotide residues) of a marker of the invention. If polynucleotides complementary to or homologous with are differentially detectable on the substrate (e.g. detectable using different chromophores or fluorophores, or fixed to different selected positions), then the levels of expression of a plurality of markers can be assessed simultaneously using a single substrate (e.g. a "gene chip" microarray of polynucleotides fixed at selected positions). When a method of assessing marker expression is used which involves hybridization of one nucleic acid with another, it is preferred that the hybridization be performed under stringent hybridization conditions.

In another embodiment, a combination of methods to assess the expression of a marker is utilized.

Because the compositions, kits, and methods of the invention rely on detection of a difference in expression levels or copy number of one or more markers of the invention, it is preferable that the level of expression or copy number of the marker is significantly greater than the minimum detection limit of the method used to assess expression or copy number in at least one of normal cells and cancerous cells.

3. Methods for Detection of Expressed Protein

The activity or level of a marker protein can also be detected and/or quantified by detecting or quantifying the expressed polypeptide. The polypeptide can be detected and quantified by any of a number of means well known to those of skill in the art. These may include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, and the like. A skilled artisan can readily adapt known protein/antibody detection methods for use in determining whether cells express a marker of the present invention.

A preferred agent for detecting a polypeptide of the invention is an antibody capable of binding to a polypeptide corresponding to a marker of the invention, preferably an antibody with a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

In a preferred embodiment, the antibody is labeled, e.g. a radio-labeled, chromophore-labeled, fluorophore-labeled, or enzyme-labeled antibody. In another embodiment, an antibody derivative (e.g. an antibody conjugated with a substrate or with the protein or ligand of a protein-ligand pair {e.g. biotin-streptavidin}), or an antibody fragment (e.g. a single-chain antibody, an isolated antibody hypervariable domain, etc.) which binds specifically with a protein corresponding to the marker, such as the protein encoded by the open reading frame corresponding to the marker or such a protein which has undergone all or a portion of its normal post-translational modification, is used.

Proteins from cells can be isolated using techniques that are well known to those of skill in the art. The protein isolation methods employed can, for example, be such as those described in Harlow and Lane (Harlow and Lane, 1988, *Antibodies: A Laboratory Manual*, Cold Spring Harbor Laboratory Press, Cold Spring Harbor, N.Y.).

In one format, antibodies, or antibody fragments, can be used in methods such as Western blots or immunofluorescence techniques to detect the expressed proteins. In such uses, it is generally preferable to immobilize either the antibody or proteins on a solid support. Suitable solid phase supports or carriers include any support capable of binding an antigen or an antibody. Well-known supports or carriers include glass, polystyrene, polypropylene, polyethylene, dextran, nylon, amylases, natural and modified celluloses, polyacrylamides, gabbros, and magnetite.

One skilled in the art will know many other suitable carriers for binding antibody or antigen, and will be able to adapt such support for use with the present invention. For example, protein isolated from cells can be run on a polyacrylamide gel electrophoresis and immobilized onto a solid phase support such as nitrocellulose. The support can then be washed with suitable buffers followed by treatment with the detectably labeled antibody. The solid phase support can then be washed with the buffer a second time to remove unbound antibody. The amount of bound label on the solid support can then be detected by conventional means. Means of detecting proteins using electrophoretic techniques are well known to those of skill in the art (see generally, R. Scopes (1982) *Protein Purification*, Springer-Verlag, N.Y.; Deutscher, (1990) *Methods in Enzymology* Vol. 182: *Guide to Protein Purification*, Academic Press, Inc., N.Y.).

In another preferred embodiment, Western blot (immunoblot) analysis is used to detect and quantify the presence of a polypeptide in the sample. This technique generally comprises separating sample proteins by gel electrophoresis on the basis of molecular weight, transferring the separated proteins to a suitable solid support, (such as a nitrocellulose filter, a nylon filter, or derivatized nylon filter), and incubating the sample with the antibodies that specifically bind a polypeptide. The anti-polypeptide antibodies specifically bind to the polypeptide on the solid support. These antibodies may be directly labeled or alternatively may be subsequently detected using labeled antibodies (e.g., labeled sheep anti-human antibodies) that specifically bind to the anti-polypeptide.

In a more preferred embodiment, the polypeptide is detected using an immunoassay. As used herein, an immunoassay is an assay that utilizes an antibody to specifically bind to the analyte. The immunoassay is thus characterized by detection of specific binding of a polypeptide to an anti-antibody as opposed to the use of other physical or chemical properties to isolate, target, and quantify the analyte.

The polypeptide is detected and/or quantified using any of a number of well recognized immunological binding assays (see, e.g., U.S. Pat. Nos. 4,366,241; 4,376,110; 4,517,288; and 4,837,168). For a review of the general immunoassays, see also Asai (1993) *Methods in Cell Biology* Volume 37: *Antibodies in Cell Biology*, Academic Press, Inc. New York; Stites & Terr (1991) *Basic and Clinical Immunology* 7th Edition.

Immunological binding assays (or immunoassays) typically utilize a "capture agent" to specifically bind to and often immobilize the analyte (polypeptide or subsequence). The capture agent is a moiety that specifically binds to the analyte. In a preferred embodiment, the capture agent is an antibody that specifically binds a polypeptide. The antibody (anti-peptide) may be produced by any of a number of means well known to those of skill in the art.

Immunoassays also often utilize a labeling agent to specifically bind to and label the binding complex formed by the capture agent and the analyte. The labeling agent may itself be one of the moieties comprising the antibody/analyte complex. Thus, the labeling agent may be a labeled polypeptide or a labeled anti-antibody. Alternatively, the labeling agent may be a third moiety, such as another antibody, that specifically binds to the antibody/polypeptide complex.

In one preferred embodiment, the labeling agent is a second human antibody bearing a label. Alternatively, the second antibody may lack a label, but it may, in turn, be bound by a labeled third antibody specific to antibodies of the species from which the second antibody is derived. The second can be modified with a detectable moiety, e.g. as biotin, to which a third labeled molecule can specifically bind, such as enzyme-labeled streptavidin.

Other proteins capable of specifically binding immunoglobulin constant regions, such as protein A or protein G may also be used as the label agent. These proteins are normal constituents of the cell walls of streptococcal bacteria. They exhibit a strong non-immunogenic reactivity with immunoglobulin constant regions from a variety of species (see, generally Kronval, et al. (1973) *J. Immunol.*, 111: 1401-1406, and Akerstrom (1985) *J. Immunol.*, 135: 2589-2542).

As indicated above, immunoassays for the detection and/or quantification of a polypeptide can take a wide variety of formats well known to those of skill in the art.

Preferred immunoassays for detecting a polypeptide are either competitive or noncompetitive. Noncompetitive immunoassays are assays in which the amount of captured analyte is directly measured. In one preferred "sandwich" assay, for example, the capture agent (anti-peptide antibodies) can be bound directly to a solid substrate where they are immobilized. These immobilized antibodies then capture polypeptide present in the test sample. The polypeptide thus immobilized is then bound by a labeling agent, such as a second human antibody bearing a label.

In competitive assays, the amount of analyte (polypeptide) present in the sample is measured indirectly by measuring the amount of an added (exogenous) analyte (polypeptide) displaced (or competed away) from a capture agent (anti-peptide antibody) by the analyte present in the sample. In one competitive assay, a known amount of, in this case, a polypeptide is added to the sample and the sample is then contacted with a capture agent. The amount of polypeptide bound to the antibody is inversely proportional to the concentration of polypeptide present in the sample.

In one particularly preferred embodiment, the antibody is immobilized on a solid substrate. The amount of polypeptide bound to the antibody may be determined either by measuring the amount of polypeptide present in a polypeptide/antibody complex, or alternatively by measuring the amount of remaining uncomplexed polypeptide. The amount of polypeptide may be detected by providing a labeled polypeptide.

The assays of this invention are scored (as positive or negative or quantity of polypeptide) according to standard methods well known to those of skill in the art. The particular method of scoring will depend on the assay format and choice of label. For example, a Western Blot assay can be scored by visualizing the colored product produced by the enzymatic label. A clearly visible colored band or spot at the correct molecular weight is scored as a positive result, while the absence of a clearly visible spot or band is scored as a negative. The intensity of the band or spot can provide a quantitative measure of polypeptide.

Antibodies for use in the various immunoassays described herein, can be produced as described herein.

In another embodiment, level (activity) is assayed by measuring the enzymatic activity of the gene product. Methods of assaying the activity of an enzyme are well known to those of skill in the art.

In vivo techniques for detection of a marker protein include introducing into a subject a labeled antibody directed against the protein. For example, the antibody can be labeled with a radioactive marker whose presence and location in a subject can be detected by standard imaging techniques.

Certain markers identified by the methods of the invention may be secreted proteins. It is a simple matter for the skilled artisan to determine whether any particular marker protein is a secreted protein. In order to make this determination, the marker protein is expressed in, for example, a mammalian cell, preferably a human cell line, extracellular fluid is collected, and the presence or absence of the protein in the extracellular fluid is assessed (e.g. using a labeled antibody which binds specifically with the protein).

The following is an example of a method which can be used to detect secretion of a protein. About $8 \times 10^5$ 293T cells are incubated at 37° C. in wells containing growth medium (Dulbecco's modified Eagle's medium {DMEM} supplemented with 10% fetal bovine serum) under a 5% (v/v) $CO_2$, 95% air atmosphere to about 60-70% confluence. The cells are then transfected using a standard transfection mixture comprising 2 micrograms of DNA comprising an expression vector encoding the protein and 10 microliters of LipofectAMINE™ (GIBCO/BRL Catalog no. 18342-012) per well. The transfection mixture is maintained for about 5 hours, and then replaced with fresh growth medium and maintained in an air atmosphere. Each well is gently rinsed twice with DMEM which does not contain methionine or cysteine (DMEM-MC; ICN Catalog no. 16-424-54). About 1 milliliter of DMEM-MC and about 50 microcuries of Trans-$^{35}$S™ reagent (ICN Catalog no. 51006) are added to each well. The wells are maintained under the 5% $CO_2$ atmosphere described above and incubated at 37° C. for a selected period. Following incubation, 150 microliters of conditioned medium is removed and centrifuged to remove floating cells and debris. The presence of the protein in the supernatant is an indication that the protein is secreted.

It will be appreciated that subject samples, e.g., a sample containing tissue, whole blood, serum, plasma, buccal scrape, saliva, cerebrospinal fluid, urine, stool, and bone marrow, may contain cells therein, particularly when the cells are cancerous, and, more particularly, when the cancer is metastasizing, and thus may be used in the methods of the present invention. The cell sample can, of course, be subjected to a variety of well-known post-collection preparative and storage techniques (e.g., nucleic acid and/or protein extraction, fixation, storage, freezing, ultrafiltration, concentration, evaporation, centrifugation, etc.) prior to assessing the level of expression of the marker in the sample. Thus, the compositions, kits, and methods of the invention can be used to detect expression of markers corresponding to proteins having at least one portion which is displayed on the surface of cells which express it. It is a simple matter for the skilled artisan to determine whether the protein corresponding to any particular marker comprises a cell-surface protein. For example, immunological methods may be used to detect such proteins on whole cells, or well known computer-based sequence analysis methods (e.g. the SIGNALP program; Nielsen et al., 1997, *Protein Engineering* 10:1-6) may be used to predict the presence of at least one extracellular domain (i.e. including both secreted proteins and proteins having at least one cell-surface domain). Expression of a marker corresponding to a protein having at least one portion which is displayed on the surface of a cell which expresses it may be detected without necessarily lysing the cell (e.g. using a labeled antibody which binds specifically with a cell-surface domain of the protein).

The invention also encompasses kits for detecting the presence of a polypeptide or nucleic acid corresponding to a marker of the invention in a biological sample, e.g., a sample containing tissue, whole blood, serum, plasma, buccal scrape, saliva, cerebrospinal fluid, urine, stool, and bone marrow. Such kits can be used to determine if a subject is suffering from or is at increased risk of developing cancer. For example, the kit can comprise a labeled compound or agent capable of detecting a polypeptide or an mRNA encoding a polypeptide corresponding to a marker of the invention in a biological sample and means for determining the amount of the polypeptide or mRNA in the sample (e.g., an antibody which binds the polypeptide or an oligonucleotide probe which binds to DNA or mRNA encoding the polypeptide). Kits can also include instructions for interpreting the results obtained using the kit.

For antibody-based kits, the kit can comprise, for example: (1) a first antibody (e.g., attached to a solid support) which binds to a polypeptide corresponding to a marker of the invention; and, optionally, (2) a second, different antibody which binds to either the polypeptide or the first antibody and is conjugated to a detectable label.

For oligonucleotide-based kits, the kit can comprise, for example: (1) an oligonucleotide, e.g., a detectably labeled oligonucleotide, which hybridizes to a nucleic acid sequence encoding a polypeptide corresponding to a marker of the invention or (2) a pair of primers useful for amplifying a nucleic acid molecule corresponding to a marker of the invention. The kit can also comprise, e.g., a buffering agent, a preservative, or a protein stabilizing agent. The kit can further comprise components necessary for detecting the detectable label (e.g., an enzyme or a substrate). The kit can also contain a control sample or a series of control samples which can be assayed and compared to the test sample. Each component of the kit can be enclosed within an individual container and all of the various containers can be within a single package, along with instructions for interpreting the results of the assays performed using the kit.

4. Method for Detecting Structural Alterations

The invention also provides a method for assessing whether a subject is afflicted with cancer or is at risk for developing cancer by comparing the structural alterations, e.g., mutations or allelic variants, of a marker in a cancer sample with the structural alterations, e.g., mutations of a marker in a normal, e.g., control sample. The presence of a structural alteration, e.g., mutation or allelic variant in the marker in the cancer sample is an indication that the subject is afflicted with cancer.

A preferred detection method is allele specific hybridization using probes overlapping the polymorphic site and having about 5, 10, 20, 25, or 30 nucleotides around the polymorphic region. In a preferred embodiment of the invention, several probes capable of hybridizing specifically to allelic variants are attached to a solid phase support, e.g., a "chip". Oligonucleotides can be bound to a solid support by a variety of processes, including lithography. For example a chip can hold up to 250,000 oligonucleotides (GeneChip, Affymetrix™). Mutation detection analysis using these chips comprising oligonucleotides, also termed "DNA probe arrays" is described e.g., in Cronin et al. (1996) *Human Mutation* 7:244. In one embodiment, a chip comprises all the allelic variants of at least one polymorphic region of a gene. The solid phase support is then contacted with a test nucleic acid and hybridization to the specific probes is detected. Accordingly, the identity of numerous allelic variants of one or more genes can be identified in a simple hybridization experiment. For example, the identity of the allelic variant of the nucleotide polymorphism in the 5' upstream regulatory element can be determined in a single hybridization experiment.

In other detection methods, it is necessary to first amplify at least a portion of a marker prior to identifying the allelic variant. Amplification can be performed, e.g., by PCR and/or LCR (see Wu and Wallace (1989) *Genomics* 4:560), according to methods known in the art. In one embodiment, genomic DNA of a cell is exposed to two PCR primers and amplification for a number of cycles sufficient to produce the required amount of amplified DNA. In preferred embodiments, the primers are located between 150 and 350 base pairs apart.

Alternative amplification methods include: self sustained sequence replication (Guatelli, J. C. et al, (1990) *Proc. Natl. Acad. Sci. USA* 87:1874-1878), transcriptional amplification system (Kwoh, D. Y. et al., (1989) *Proc. Natl. Acad. Sci. USA* 86:1173-1177), Q-Beta Replicase (Lizardi, P. M. et al., (1988) *Bio/Technology* 6:1197), and self-sustained sequence replication (Guatelli et al., (1989) *Proc. Nat. Acad. Sci.* 87:1874), and nucleic acid based sequence amplification (NABSA), or any other nucleic acid amplification method, followed by the detection of the amplified molecules using techniques well known to those of skill in the art. These detection schemes are especially useful for the detection of nucleic acid molecules if such molecules are present in very low numbers.

In one embodiment, any of a variety of sequencing reactions known in the art can be used to directly sequence at least a portion of a marker and detect allelic variants, e.g., mutations, by comparing the sequence of the sample sequence with the corresponding reference (control) sequence. Exemplary sequencing reactions include those based on techniques developed by Maxam and Gilbert (*Proc. Natl. Acad Sci USA* (1977) 74:560) or Sanger (Sanger et al. (1977) *Proc. Nat. Acad. Sci.* 74:5463). It is also contemplated that any of a variety of automated sequencing procedures may be utilized when performing the subject assays (*Biotechniques* (1995) 19:448), including sequencing by mass spectrometry (see, for example, U.S. Pat. No. 5,547,835 and international patent application Publication Number WO 94/16101, entitled DNA Sequencing by Mass Spectrometry by H. Köster; U.S. Pat. No. 5,547,835 and international patent application Publication Number WO 94/21822 entitled DNA Sequencing by Mass Spectrometry Via Exonuclease Degradation by H. Köster), and U.S. Pat. No. 5,605,798 and International Patent Application No. PCT/US96/03651 entitled DNA Diagnostics Based on Mass Spectrometry by H. Köster; Cohen et al. (1996) *Adv Chromatogr* 36:127-162; and Griffin et al. (1993) *Appl Biochem Biotechnol* 38:147-159). It will be evident to one skilled in the art that, for certain embodiments, the occurrence of only one, two or three of the nucleic acid bases need be determined in the sequencing reaction. For instance, A-track or the like, e.g., where only one nucleotide is detected, can be carried out.

Yet other sequencing methods are disclosed, e.g., in U.S. Pat. No. 5,580,732 entitled "Method of DNA sequencing employing a mixed DNA-polymer chain probe" and U.S. Pat. No. 5,571,676 entitled "Method for mismatch-directed in vitro DNA sequencing."

In some cases, the presence of a specific allele of a marker in DNA from a subject can be shown by restriction enzyme analysis. For example, a specific nucleotide polymorphism can result in a nucleotide sequence comprising a restriction site which is absent from the nucleotide sequence of another allelic variant.

In a further embodiment, protection from cleavage agents (such as a nuclease, hydroxylamine or osmium tetroxide and with piperidine) can be used to detect mismatched bases in RNA/RNA DNA/DNA, or RNA/DNA heteroduplexes (Myers, et al. (1985) *Science* 230:1242). In general, the technique of "mismatch cleavage" starts by providing heteroduplexes formed by hybridizing a control nucleic acid, which is optionally labeled, e.g., RNA or DNA, comprising a nucleotide sequence of a marker allelic variant with a sample nucleic acid, e.g., RNA or DNA, obtained from a tissue sample. The double-stranded duplexes are treated with an agent which cleaves single-stranded regions of the duplex such as duplexes formed based on basepair mismatches between the control and sample strands. For instance, RNA/DNA duplexes can be treated with RNase and DNA/DNA hybrids treated with S1 nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine whether the control and sample nucleic acids have an identical nucleotide sequence or in which nucleotides they are different. See, for example, Cotton et al (1988) *Proc. Natl. Acad Sci USA* 85:4397; Saleeba et al (1992) *Methods Enzymol.* 217:286-295. In a preferred embodiment, the control or sample nucleic acid is labeled for detection.

In another embodiment, an allelic variant can be identified by denaturing high-performance liquid chromatography (DHPLC) (Oefner and Underhill, (1995) *Am. J. Human Gen.* 57:Suppl. A266). DHPLC uses reverse-phase ion-pairing chromatography to detect the heteroduplexes that are generated during amplification of PCR fragments from individuals who are heterozygous at a particular nucleotide locus within that fragment (Oefner and Underhill (1995) *Am. J. Human Gen.* 57:Suppl. A266). In general, PCR products are produced using PCR primers flanking the DNA of interest. DHPLC analysis is carried out and the resulting chromatograms are analyzed to identify base pair alterations or deletions based on specific chromatographic profiles (see O'Donovan et al. (1998) *Genomics* 52:44-49).

In other embodiments, alterations in electrophoretic mobility are used to identify the type of marker allelic variant. For example, single strand conformation polymorphism (SSCP) may be used to detect differences in electrophoretic mobility between mutant and wild type nucleic acids (Orita et al. (1989) *Proc Natl. Acad. Sci. USA* 86:2766, see also Cotton (1993) *Mutat Res* 285:125-144; and Hayashi (1992) *Genet Anal Tech Appl* 9:73-79). Single-stranded DNA fragments of sample and control nucleic acids are denatured and allowed to renature. The secondary structure of single-stranded nucleic acids varies according to sequence and the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In another preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment, the identity of an allelic variant of a polymorphic region is obtained by analyzing the movement of a nucleic acid comprising the polymorphic region in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing agent gradient to identify differences in the mobility of control and sample DNA (Rosenbaum and Reissner (1987) *Biophys Chem* 265: 1275).

Examples of techniques for detecting differences of at least one nucleotide between two nucleic acids include, but are not limited to, selective oligonucleotide hybridization, selective amplification, or selective primer extension. For example, oligonucleotide probes may be prepared in which the known polymorphic nucleotide is placed centrally (allele-specific probes) and then hybridized to target DNA under conditions which permit hybridization only if a perfect match is found (Saiki et al. (1986) *Nature* 324:163); Saiki et al (1989) *Proc. Natl. Acad. Sci. USA* 86:6230; and Wallace et al. (1979) *Nucl. Acids Res.* 6:3543). Such allele specific oligonucleotide hybridization techniques may be used for the simultaneous detection of several nucleotide changes in different polylmorphic regions of marker. For example, oligonucleotides having nucleotide sequences of specific allelic variants are attached to a hybridizing membrane and this membrane is then hybridized with labeled sample nucleic acid. Analysis of the hybridization signal will then reveal the identity of the nucleotides of the sample nucleic acid.

Alternatively, allele specific amplification technology which depends on selective PCR amplification may be used in conjunction with the instant invention. Oligonucleotides used as primers for specific amplification may carry the allelic variant of interest in the center of the molecule (so that amplification depends on differential hybridization) (Gibbs et al (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238; Newton et al. (1989) *Nucl. Acids Res.* 17:2503). This technique is also termed "PROBE" for Probe Oligo Base Extension. In addition it may be desirable to introduce a novel restriction site in the region of the mutation to create cleavage-based detection (Gasparini et al (1992) *Mol. Cell. Probes* 6:1).

In another embodiment, identification of the allelic variant is carried out using an oligonucleotide ligation assay (OLA), as described, e.g., in U.S. Pat. No. 4,998,617 and in Landegren, U. et al., (1988) *Science* 241:1077-1080. The OLA protocol uses two oligonucleotides which are designed to be capable of hybridizing to abutting sequences of a single strand of a target. One of the oligonucleotides is linked to a separation marker, e.g., biotinylated, and the other is detectably labeled. If the precise complementary sequence is found in a target molecule, the oligonucleotides will hybridize such that their termini abut, and create a ligation substrate. Ligation then permits the labeled oligonucleotide to be recovered using avidin, or another biotin ligand. Nickerson, D. A. et al. have described a nucleic acid detection assay that combines attributes of PCR and OLA (Nickerson, D. A. et al., (1990) *Proc. Natl. Acad. Sci.* (*U.S.A.*) 87:8923-8927. In this method, PCR is used to achieve the exponential amplification of target DNA, which is then detected using OLA.

The invention further provides methods for detecting single nucleotide polymorphisms in a marker. Because single nucleotide polymorphisms constitute sites of variation flanked by regions of invariant sequence, their analysis requires no more than the determination of the identity of the single nucleotide present at the site of variation and it is unnecessary to determine a complete gene sequence for each subject. Several methods have been developed to facilitate the analysis of such single nucleotide polymorphisms.

In one embodiment, the single base polymorphism can be detected by using a specialized exonuclease-resistant nucleotide, as disclosed, e.g., in Mundy, C. R. (U.S. Pat. No. 4,656,127). According to the method, a primer complementary to the allelic sequence immediately 3' to the polymorphic site is permitted to hybridize to a target molecule obtained from a particular animal or human. If the polymorphic site on the target molecule contains a nucleotide that is complementary to the particular exonuclease-resistant nucleotide derivative present, then that derivative will be incorporated onto the end of the hybridized primer. Such incorporation renders the primer resistant to exonuclease, and thereby permits its detection. Since the identity of the exonuclease-resistant derivative of the sample is known, a finding that the primer has become resistant to exonucleases reveals that the nucleotide present in the polymorphic site of the target molecule was complementary to that of the nucleotide derivative used in the reaction. This method has the advantage that it does not require the determination of large amounts of extraneous sequence data.

In another embodiment of the invention, a solution-based method is used for determining the identity of the nucleotide of a polymorphic site (Cohen, D. et al. French Patent 2,650, 840; PCT Appln. No. WO91/02087). As in the Mundy method of U.S. Pat. No. 4,656,127, a primer is employed that is complementary to allelic sequences immediately 3' to a polymorphic site. The method determines the identity of the nucleotide of that site using labeled dideoxynucleotide derivatives, which, if complementary to the nucleotide of the polymorphic site will become incorporated onto the terminus of the primer.

An alternative method, known as Genetic Bit Analysis or GBA™ is described by Goelet, P. et al. (PCT Appln. No. 92/15712). The method of Goelet, P. et al. uses mixtures of labeled terminators and a primer that is complementary to the sequence 3' to a polymorphic site. The labeled terminator that is incorporated is thus determined by, and complementary to, the nucleotide present in the polymorphic site of the target molecule being evaluated. In contrast to the method of Cohen et al. (French Patent 2,650,840; PCT Appln. No. WO91/ 02087) the method of Goelet, P. et al. is preferably a heterogeneous phase assay, in which the primer or the target molecule is immobilized to a solid phase.

Several primer-guided nucleotide incorporation procedures for assaying polymorphic sites in DNA have been described (Komher, J. S. et al., (1989) *Nucl. Acids. Res.* 17:7779-7784; Sokolov, B. P., (1990) *Nucl. Acids Res.* 18:3671; Syvanen, A.-C., et al., (1990) *Genomics* 8:684-692; Kuppuswamy, M. N. et al., (1991) *Proc. Natl. Acad. Sci.* (*U.S.A.*) 88:1143-1147; Prezant, T. R. et al., (1992) *Hum. Mutat.* 1:159-164; Ugozzoli, L. et al., (1992) *GATA* 9:107- 112; Nyren, P. (1993) et al., *Anal. Biochem.* 208:171-175). These methods differ from GBA™ in that they all rely on the incorporation of labeled deoxynucleotides to discriminate between bases at a polymorphic site. In such a format, since the signal is proportional to the number of deoxynucleotides incorporated, polymorphisms that occur in runs of the same nucleotide can result in signals that are proportional to the length of the run (Syvanen, A. C., et al., (1993) *Amer. J. Hum. Genet.* 52:46-59).

For determining the identity of the allelic variant of a polymorphic region located in the coding region of a marker, yet other methods than those described above can be used. For example, identification of an allelic variant which encodes a mutated marker can be performed by using an antibody specifically recognizing the mutant protein in, e.g., immunohistochemistry or immunoprecipitation. Antibodies to wild-type marker or mutated forms of markers can be prepared according to methods known in the art.

Alternatively, one can also measure an activity of a marker, such as binding to a marker ligand. Binding assays are known in the art and involve, e.g., obtaining cells from a subject, and performing binding experiments with a labeled ligand, to determine whether binding to the mutated form of the protein differs from binding to the wild-type of the protein.

B. Pharmacogenomics

Agents or modulators which have a stimulatory or inhibitory effect on amount and/or activity of a marker of the invention can be administered to individuals to treat (prophylactically or therapeutically) cancer in the subject. In conjunction with such treatment, the pharmacogenomics (i.e., the study of the relationship between an individual's genotype and that individual's response to a foreign compound or drug) of the individual may be considered. Differences in metabolism of therapeutics can lead to severe toxicity or therapeutic failure by altering the relation between dose and blood concentration of the pharmacologically active drug. Thus, the pharmacogenomics of the individual permits the selection of effective agents (e.g., drugs) for prophylactic or therapeutic treatments based on a consideration of the individual's genotype. Such pharmacogenomics can further be used to determine appropriate dosages and therapeutic regimens. Accordingly, the amount, structure, and/or activity of the invention in an individual can be determined to thereby select appropriate agent(s) for therapeutic or prophylactic treatment of the individual.

Pharmacogenomics deals with clinically significant variations in the response to drugs due to altered drug disposition and abnormal action in affected persons. See, e.g., Linder (1997) Clin. Chem. 43(2):254-266. In general, two types of pharmacogenetic conditions can be differentiated. Genetic conditions transmitted as a single factor altering the way drugs act on the body are referred to as "altered drug action." Genetic conditions transmitted as single factors altering the way the body acts on drugs are referred to as "altered drug metabolism". These pharmacogenetic conditions can occur either as rare defects or as polymorphisms. For example, glucose-6-phosphate dehydrogenase (G6PD) deficiency is a common inherited enzymopathy in which the main clinical complication is hemolysis after ingestion of oxidant drugs (anti-malarials, sulfonamides, analgesics, nitrofurans) and consumption of fava beans.

As an illustrative embodiment, the activity of drug metabolizing enzymes is a major determinant of both the intensity and duration of drug action. The discovery of genetic polymorphisms of drug metabolizing enzymes (e.g., N-acetyltransferase 2 (NAT 2) and cytochrome P450 enzymes CYP2D6 and CYP2C19) has provided an explanation as to why some subjects do not obtain the expected drug effects or show exaggerated drug response and serious toxicity after taking the standard and safe dose of a drug. These polymorphisms are expressed in two phenotypes in the population, the extensive metabolizer (EM) and poor metabolizer (PM). The prevalence of PM is different among different populations. For example, the gene coding for CYP2D6 is highly polymorphic and several mutations have been identified in PM, which all lead to the absence of functional CYP2D6. Poor metabolizers of CYP2D6 and CYP2C19 quite frequently experience exaggerated drug response and side effects when they receive standard doses. If a metabolite is the active therapeutic moiety, a PM will show no therapeutic response, as demonstrated for the analgesic effect of codeine mediated by its CYP2D6-formed metabolite morphine. The other extreme are the so called ultra-rapid metabolizers who do not respond to standard doses. Recently, the molecular basis of ultra-rapid metabolism has been identified to be due to CYP2D6 gene amplification.

Thus, the amount, structure, and/or activity of a marker of the invention in an individual can be determined to thereby select appropriate agent(s) for therapeutic or prophylactic treatment of the individual. In addition, pharmacogenetic studies can be used to apply genotyping of polymorphic alleles encoding drug-metabolizing enzymes to the identification of an individual's drug responsiveness phenotype. This knowledge, when applied to dosing or drug selection, can avoid adverse reactions or therapeutic failure and thus enhance therapeutic or prophylactic efficiency when treating a subject with a modulator of amount, structure, and/or activity of a marker of the invention.

C. Monitoring Clinical Trials

Monitoring the influence of agents (e.g., drug compounds) on amount, structure, and/or activity of a marker of the invention can be applied not only in basic drug screening, but also in clinical trials. For example, the effectiveness of an agent to affect marker amount, structure, and/or activity can be monitored in clinical trials of subjects receiving treatment for cancer. In a preferred embodiment, the present invention provides a method for monitoring the effectiveness of treatment of a subject with an agent (e.g., an agonist, antagonist, peptidomimetic, protein, peptide, antibody, nucleic acid, antisense nucleic acid, ribozyme, small molecule, RNA interfering agent, or other drug candidate) comprising the steps of (i) obtaining a pre-administration sample from a subject prior to administration of the agent; (ii) detecting the amount, structure, and/or activity of one or more selected markers of the invention in the pre-administration sample; (iii) obtaining one or more post-administration samples from the subject; (iv) detecting the amount, structure, and/or activity of the marker(s) in the post-administration samples; (v) comparing the amount, structure, and/or activity of the marker(s) in the pre-administration sample with the amount, structure, and/or activity of the marker(s) in the post-administration sample or samples; and (vi) altering the administration of the agent to the subject accordingly. For example, increased administration of the agent can be desirable to increase amount and/or activity of the marker(s) to higher levels than detected, i.e., to increase the effectiveness of the agent. Alternatively, decreased administration of the agent can be desirable to decrease amount and/or activity of the marker(s) to lower levels than detected, i.e., to decrease the effectiveness of the agent.

EXEMPLIFICATION

This invention is further illustrated by the following examples which should not be construed as limiting. The contents of all references, figures, sequence listing, patents and published patent applications cited throughout this application are hereby incorporated by reference.

Example 1

A. Materials and Methods

Primary tumor genomic DNA and multiple myeloma cell lines. Genomic DNA from primary tumors derived from the Donna D. and Donald M. Lambert Laboratory of Myeloma Genetics, Myeloma Institute for Research and Therapy, University of Arkansas for Medical Sciences (n=67) (Barlogie et al. (2006) N Engl J Med in press.). Patients were treated with the TT2 Protocol (median follow-up 43 months, range: 5 months to 65 months) (Barlogie et al. (2006) N Engl J Med in press.) (Table 3). MM cell lines were collected at the Genetics Branch, National Cancer Institutes (M. K.), Weill Medical College and Graduate School of Medical Sciences of Cornell University (L. B.) and Jerome Lipper Multiple Myeloma Center, the Department of Medical Oncology, Dana-Farber Cancer Institute, Inc. (K. A.) (G. T. and R. A. D., unpublished data).

Figure 9:
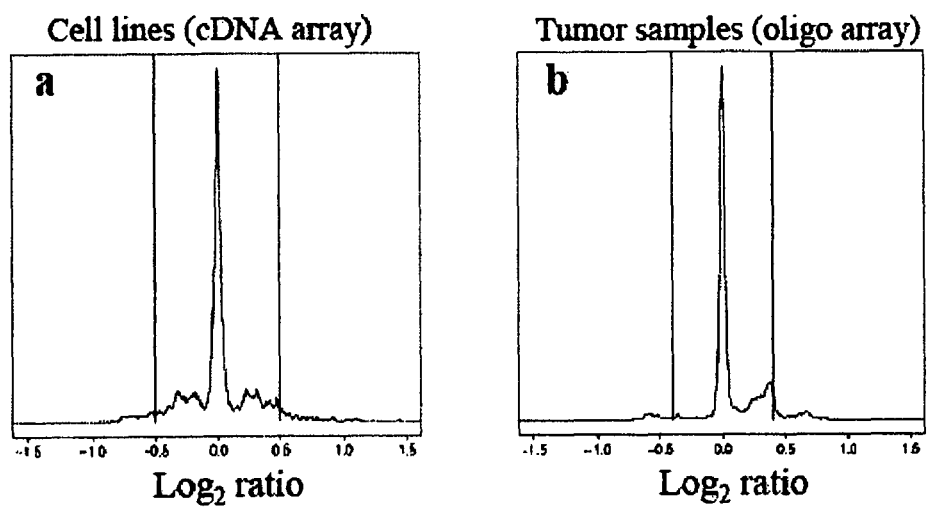
FIGS. 9A-B depict thresholds for determining altered copy number in aCGH data are based on the distribution of averaged log 2 ratios in segmented datasets for (A) cell lines and (B) tumor samples. Gain/loss thresholds (gray lines) are defined as +/−4 standard deviations of the middle 50% of the data. Amplification and deletion thresholds (blue lines) are chosen arbitrarily based on the distributions shown.

Array-CGH profiling on oligonucleotide (oligo) and cDNA microarrays. DNA from primary tumors was obtained from CD138 enriched cell population using CD138 magnetic microbeads (Myltenyi Biotec Inc.). Genomic DNA from cell lines and primary tumors were extracted according to manufacturer instructions (Gentra System Inc., Minneapolis, Minn.). Genomic DNA was fragmented and random-prime labeled as described (for details, see the world wide web at extension genomic.dfci.harvard.edu/array-CGH) and hybridized to either human cDNA or oligo microarrays. All MM cell lines were analyzed using a cDNA array platform (Aguirre et al. (2004) Proc Natl Acad Sci USA 101, 9067-9072), while the 67 primary tumors from Arkansas were analyzed using the oligonucleotide array platform and the 6 derived at Cornell using the cDNA platform (Tonon et al. (2005) Proc Natl Acad Sci USA 102, 9625-9630; Brennan et al. (2004) Cancer Res 64, 4744-4748). The cDNA microarray contains 14,160 cDNA clones (Agilent Technologies, Human 1 clone set) with 13,281 genome-mappable clones, for which approximately 11,211 unique map positions were defined (National Center for Biotechnology Information, NCBI, Build 35). The median interval between mapped elements is 72.7 kilobase (Kb), 94.1% of intervals are less than 1 megabase (Mb), and 98.9% are less than 3 Mb. The oligo array contains 22,500 elements designed for expression profiling (Agilent Technologies, Human 1A V2), for which 16,097 unique map positions were defined (Build 35). The median interval between mapped elements is 54.8 kb, 96.7% of intervals are <1 Mb, and 99.5% are <3 Mb. Fluorescence ratios of scanned images of the arrays were calculated as the average of two paired arrays (dye swap), and the raw array-CGH profiles were processed to identify statistically significant transitions in copy number using a segmentation algorithm, as previously described (Aguirre et al. (2004) Proc Natl Acad Sci USA 101, 9067-9072; Olshen et al. (2004) Biostatistics 5, 557-572). The data are centered by the tallest mode in the distribution of the segment values. After mode-centering, we defined gains and losses for the oligonucleotide dataset as log 2 ratios$\geq$+ 0.11 or −0.11 (±4 SD of the middle 50% quantile of data) and amplification and deletion as a ratio>0.4 or <−0.4, respectively. For the cDNA dataset, gains and losses were defined as log 2 ratios of $\geq$+0.13 or −0.13 (±4 SD of the middle 50% quantile of data) and amplification and deletion as a ratio>0.5 or <−0.5, respectively. The segmented log 2 ratio distributions and thresholds chosen are shown in FIG. 9. The narrow central peak sharply defines "normal" copy number for a sample (most common chromosomal copy number, not necessarily diploid). Thus "abnormal" (relative gain/loss) is well-defined by tight thresholds (±4 SD of the middle 50% quantile).

Adaptation of the NMF algorithm to aCGH analysis and Fisher's exact test. The algorithm used for aCGH analysis is a modification of NMF, non-negative matrix factorization, that entails conversion of array-CGH data followed by NMF-based classification (Brennan et al, in preparation). NMF is a method designed to reduce data dimensionality based on matrix decomposition by parts, and it has recently been shown to be effective in elucidating meaningful structure inherent in gene expression datasets: organizing both the genes and samples to provide biologically or clinically relevant correlations (Brunet et al. (2004) Proc Natl Acad Sci USA 101, 416-44169). Only segmented aCGH data and the 67 primary tumor samples were analyzed. Briefly, the aCGH dataset was first dimension reduced by eliminating redundant probes, defined as two or more probes showing identical segmented values in all samples. In this manner, 16084 mapped probes were reduced to 942 genomic regions of unique segmented values. The reduced aCGH data (67 samples by 942 regions) were converted to non-negative values by assigning two dimensions to each of the regions: a "gain" dimension for log 2 ratios greater than zero, and a "loss" dimension for the absolute value of log 2 ratios less than zero. The resultant dataset is a non-negative matrix of dimension 67×1884 which is subject to NMF using the software package published by Brunet et al. (Brunet et al. (2004) Proc Natl Acad Sci USA 101, 4164-4169) and run in MATLAB (The MathWorks, Inc.). For each factor level two though six, NMF is repeated 1000 times to build a consensus matrix, and this is used to assign samples to clusters based on the most common consensus. As a measure of stability, the cluster assignments were repeated with a random 10% of the samples excluded on each iteration and a nearly identical clustering was observed.

Fisher's exact test was used to identify the regions of the genome presenting significantly different occurrence of copy number gains or losses between k1 and k2 groups. Briefly, for each sample, each of the 942 genomic regions was classified as having copy number normal, gained or lost based on Log 2 ratio thresholds of +/−0.13. Then a 2×2 contingency table was tested for k1 vs. k2 samples gained vs. normal; a second matrix tested lost vs. normal. Fisher's exact test p-values were corrected for multiple testing ("qvalue" function, R package "qvalue", cran.rproject.org).

Expression Profiling on Affiymetrix GeneChip. Detailed protocols for RNA purification, cDNA synthesis, cRNA preparation, and hybridization to the Affymetrix H133A and H133 Plus 2.0 GeneChip microarray was performed as described (Zhan et al. (2003) Blood 101, 1128-1140). As control, RNA was derived from CD-138-selected bone marrow-derived plasma cells from 12 healthy donors, as described (Zhan et al. (2003) Blood 101, 1128-1140). The genomic positions for each gene were mapped based on NCBI Build 35 of human genome. Significance Analysis of Microarrays (SAM) was performed as described (Tusher et al. (2001) Proc Natl Acad Sci USA 98, 5116-5121).

Integrated copy number and expression analysis. For each gene probe-set falling within an amplified MCR, two different analyses of gene expression were conducted: (1) expression in tumors with CNA compared to normal plasma cells, and (2) expression in tumors without CNA compared to normal plasma cells. Because of the widely varying proportion of copy-number-altered samples in each MCR, SAM was impractical to apply generally to the two measures. Thus, all expression comparisons were instead performed using the same "gene weight" measure, similar to T-score, as described below and in previous publications (Aguirre et al. (2004) Proc Natl Acad Sci USA 101, 9067-9072; Hyman et al. (2002) Cancer Res 62, 6240-6245). For each gene probe-set, gene weight (GW) of expression values for test set "T" compared to reference set "R" is calculated by:

$$GW_{T\text{vs.}R} = \frac{\overline{T} - \overline{R}}{\sigma^T + \sigma^R}$$

Significance was determined by permuting sample labels for expression data (1000 permutations, P value equal or below 0.001).

Gene Set Enrichment Analysis (GSEA). GSEA has been described elsewhere (Mootha et al. (2003) Nat Genet 34, 267-273). Briefly, the method requires two inputs: (i) a list of genes that have been ranked according to expression difference between two states and (ii) a priori defined gene sets (e.g., pathways), each consisting of members drawn from this list. The 95 pathways were derived from (Monti et al. (2005) Blood 105, 1851-1861; Mootha et al. (2003) Nat Gene. 34, 267-273). No normalization was applied to the data. The ranking metric used was Signal2Noise, with a weighted ES scoring scheme. The phenotype was permuted, with 1000 permutations.

QPCR verification and fluorescence in situ hybridization. PCR primers were designed to amplify products of 100-150 bp within target and control sequences as previously described (Aguirre et al. (2004) Proc Natl Acad Sci USA 101, 9067-9072). Metaphase spread slides were prepared following standard protocols (Protopopov et al. (1996) Chromosome Res 4, 443-447). The BACs RPC11 HS (chr.1, spanning BCL9), RP11-180M15 (chr12, spanning CDKN1B) and RP11-237C13 were used for the hybridizations. The probes for the FISH analysis were labeled using nick translation, according to the manufacturer's instructions (Roche Molecular Biochemicals, Indianapolis, Ind.) with either biotin-14-dATP or digoxigenin-11-dUTP. Biotinylated probes were detected using Cy3-conjugated avidin (Accurate Chemical, Westbury, N.Y.). For digoxigenin-labeled probes, antidigoxigenin-FITC Fab fragments (Enzo Life Sciences, Farmingdale, N.Y.) were used. Slides were counterstained with 5 ug/ml 4',6-diamidino-2-phenylindole (Merck) and mounted in Vectashield antifade medium (Vector Laboratories, Burlingame, Calif.). FISH signals acquisition and spectral analysis was performed using filter sets and software developed by Applied Spectral Imaging (Carlsbad, Calif.).

Automated MCR Definition. Loci of amplification and deletion are evaluated across samples with an effort to define MCRs targeted by overlapping events in two or more samples.

An algorithmic approach has been previously described (Tonon et al. (2005) Proc Natl Acad Sci USA 102:9625-9630; Aquirre et al. (2004) Proc Natl Acad Sci USA 101:9067-9072). It is applied to the segmented data as follows:

1. Segments with values>0.4 or <−0.4 (0.5 and −0.5 for cDNA) are identified as altered.
2. If two or more similarly altered segments are adjacent in a single profile or separated by <500 kb, the entire region spanned by the segments is considered to be an altered span.
3. Altered segments or spans <20 Mb are retained as "informative spans" for defining discrete locus boundaries. Longer regions are not discarded, but are not included in defining locus boundaries.
4. Informative spans are compared across samples to identify overlapping amplified or deleted regions (informative spans only); each is called an "overlap group."
5. Overlap groups are divided into separate groups wherever the recurrence rate falls <25% of the peak recurrence for the whole group. Recurrence is calculated by counting the number of samples with alteration at high threshold (±0.4, or 0.5 and −0.5 for cDNA).
6. MCRs are defined as contiguous spans within an overlap group, having at least 75% of the peak recurrence. If there are more than three MCRs in a locus, the whole region is reported as a single complex MCR. In cases where MCRs were defined by two overlapping CNAs, MCR inclusion in the final list and boundary definition was subjected to individual review.

Identification of MCRs with potential prognostic significance. As described above for NMF analysis, for each unique genomic region in the aCGH (segmented data) the samples are divided into those that have copy gain versus the rest, and those that have copy loss versus the rest. This is based on a low threshold of log 2=0.13. For each genomic region Kaplan-Meyer survival was calculated for each pair of altered/unaltered groups. The survival curves were tested for significant difference via log rank test (survdiff function, Survival package, cran.r-project.org). The regions showing a p value less or equal to 0.05 were then mapped to the MCRs.

Derivation of "pseudo-CGH" in a validation set of 281 samples. Affymetrix expression profiles (U133plus2) were obtained for 281 clinically-annotated samples of MM treated with TT2. The data were normalized and converted to expression level via MAS 5.0 software. Profiles were converted to log 2 expression and individual genes standardized by subtracting the mean and dividing by the standard deviation. These values were averaged across all genes on each of the chromosomal arms yielding single values. For each sample, the values were centered by the average of the most invariant chromosomes (chrs 2, 4, 6, 8, 10, 12, 17, 18 and 20). Finally, for each chromosomal arm, the distributions across all 281 samples were then centered to the mode (or to the peak mode for multimodal distributions). The result is a pCGH measure for each chromosomal arm which is zero for normal copy number, and positive/negative for gain/loss, respectively.

Validation of pCGH using FISH. pCGH estimates of gain/loss were compared to FISH results obtained in the same samples for probes located on 13q (n=244) and 1q (n=191). The results were reasonably concordant, establishing pCGH as a reasonable surrogate for detecting both losses (13q) and gains (1q).

Figure 3:
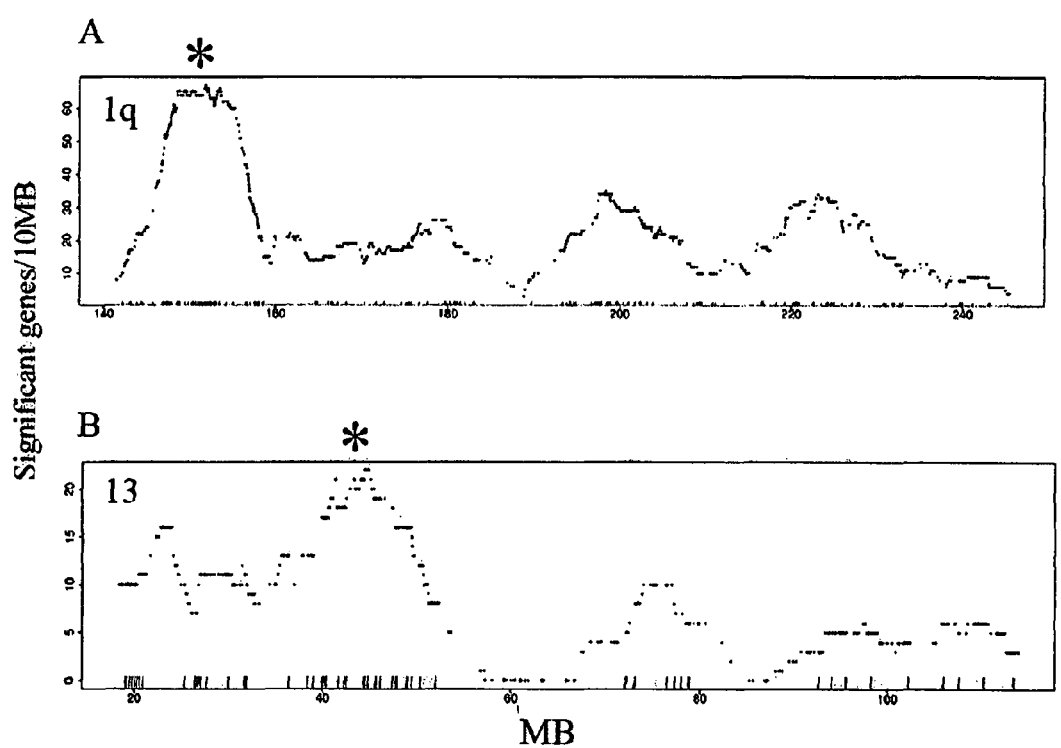
FIGS. 3A-B depict a distribution of genes differentially expressed between k1 and k2 subgroups and residing on chromosomes 1q (A) and 13 (B). Expression probe sets (Affymetrix) are mapped to their respective genomic positions and are shown as vertical hash marks along the bottom of each plot. Black hash marks denote genes found to be differentially expressed between k1 and k2 subgroups by SAM (see methods). Count of significant genes within a moving 10 MB window is shown (y-axis) and asterisks indicate the center of regions of significant clustering (p<0.05 by permutation testing). The significant region spans approximately 143-158 MB for ch1 and 38-50 MB for ch 13, though boundaries are approximate based on the moving window width.

Defining hyperdiploid pattern (odd-chromosome gain) by pCGH. pCGH values for the characteristic set of odd chromosomes (chrs 3, 5, 7, 9, 15 and 19) were averaged for each sample and the averages show a bimodal distribution with the higher mode representing the subset of hyperdiploid tumors. This pCGH-based score was used to classify samples as hyperdiploid or not; as with FISH, samples showing an intermediate score were excluded as ambiguous calls (FIG. 3).

B. Results

Figure 5:
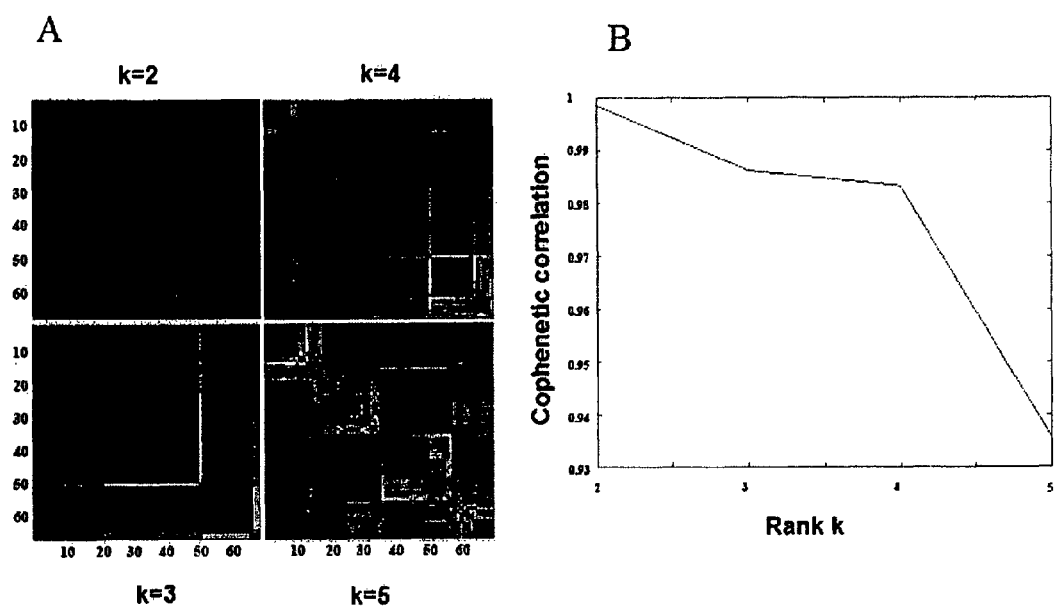
FIGS. 5A-B depicts that a NMF finds stable clustering for ranks 2, 3 and 4 but not for ranks 5 or higher, suggesting up to 4 natural subgroups in the genomic profiles. (A). Consensus matrices show how often samples are assigned to the same clusters during 1000 repetitions of NMF, computed at k=2-5 for 67 primary tumor MM data set. Each pixel represents how often a particular pair of samples cluster together, colored from 0% (deep blue, samples are never in the same cluster) to 100% (dark red, samples are always in the same cluster). Ranks 2, 3 and 4 show largely stable assignments into 2, 3 and 4 blocks, respectively, whereas rank 5 is disrupted. (B). Cophenetic correlation coefficients for hierarchically clustered matrices in A. Valid clusterings should show correlation close to 1.

Unsupervised classification based on genomic features of MM genome identifies distinct patient subgroups. High-resolution array-CGH methodology was used to catalogue copy number aberrations (CNAs) in the genomes of CD138+-enriched plasma cells (>90% CD138+/CD45−) derived from 67 newly diagnosed MM patients prior to treatment (Table 3). This dataset revealed a highly re-arranged MM genome, harboring large numbers of distinct CNAs. Since genomic alterations hold the potential to identify genetic events playing direct roles in disease pathogenesis and progression (Aguirre et al. (2004) Proc Natl Acad Sci USA 101, 9067-9072; Pollack et al. (2002) Proc Natl Acad Sci USA 99, 12963-12968; Tonon et al. (2005) Proc Natl Acad Sci USA 102, 9625-9630), MM genomic profiles were investigated to determine whether these profiles could specify meaningful genetic and clinical subgroups by unsupervised methodologies. A novel algorithm was developed based on non-negative matrix factorization (NMF) (Brunet et al. (2004) Proc Natl Acad Sci USA 101, 4164-4169) (see Materials and Methods in Example 1A), designed to extract distinctive genomic features from array-CGH profiles, hereafter designated as gNMF. Briefly, NMF was performed on array-CGH data transformed to non-negative values and NMF consensus matrices were generated (FIG. 5). Ranks K=2, 3 and 4 generated matrices showing stable cluster assignments suggesting existence of up to 4 distinct genomic patterns among the 67 mM samples.

The rank K=2 classification divided these 67 samples into a "kA" subgroup (n=38) characterized by odd-chromosome gains (viz., chromosomes 3, 5, 7, 9, 11, 15, 19 and 21) and a "kB" subgroup (n=29) characterized by loss of chromosomes 1p, 8p, 13, and 16q and amplification of chr1q (FIG. 1A). Thus, the K=2 classification yields a grouping that is strongly reminiscent of the well-recognized hyperdiploid (e.g. odd-chromosome gain pattern) and non-hyperdiploid subclasses. However, when correlated with clinical outcome data, the kA (hyperdiploid) subgroup showed only a trend toward improved survival over kB (nonhyperdiploid) subgroup (FIGS. 1B and 1C; see below), raising the possibility that further genomic subclasses exist within kA and kB. Indeed, with rank K=4 matrix, these 67 MM samples were subdivided by gNMF into 4 distinct molecular subclasses, k1-k4 (FIG. 2A). All 21 of the k1 and 16 of the k2 samples belonged to the previous kA subgroup, while all 13 of the k3 and 16 of the 17 k4 samples were contained in the previous kB subgroup. Unbiased genomewide classification of genomic alterations provided molecular evidence that MM is a heterogeneous disease, and that the traditional hyperdiploid MM class consists of two molecular subclasses.

Definition of a subclass of hyperdiploid MM with poor prognosis. Although considered a relatively good prognosis group, hyperdiploid MM patients (kA subgroup) did not uniformly survive longer in the cohort (FIG. 1B, log rank test p=0.25 and 0.10 for event-free-survival (EFS) and overall-survival (OS), respectively). Since gNMF classification with K4 rank showed that kA was composed of k1 and k2 subclasses, it was then determined whether outcome of patients in k1 and k2 differed. Here, Kaplan-Meier curves for k1 (n=21) and k2 (n=16) patients were generated for EFS and OS with median follow-up of 43.4 months post TT2 regimen (FIG. 2B). Clearly, k1 possessed a significant event-free survival advantage with a trend for better overall survival over k2 (log rank test p=0.012 for EFS and p=0.12 for OS), indicating that the genomic heterogeneity in hyperdiploid MM holds biological relevance and embedded within it are molecular events dictating clinical behavior of the disease.

As the first step toward elucidating genetic determinants of outcome in hyperdiploid MM, the high-degree of relatedness between k1 and k2 genomes was exploited to uncover clinically relevant CNAs. As mentioned above, k1 and k2 share the conventional pattern of odd chromosome gains (chr3, 5, 7, 9, 15, 19 and 21) (FIG. 2A). Comparison of k1 vs k2 genomic patterns (see Materials and Methods above) identified several prominent features, which include: (i) chr11 gain in 20/21 k1 versus only 6/16 k2 samples (p<0.001, $\chi^2$ test); (ii) gains of chr1q in 9/16 k2 versus 0/21 k1 samples (p<0.001); and (iii) chr13 loss in 10/16 k2 versus only 4/21 k1 samples (p=0.019). Consistently, these three features were among the major components defined by gNMF in the K4 classification (FIG. 2A).

Taken together, the analysis suggested that, among hyperdiploid MM, chr11 gain confers a more favorable outcome, whereas chr1q gain and chr13 loss signify higher risk of poor outcome.

Next, to mine chr1q and chr13 genes conferring high risk in the k2 subgroup, the Significance Analysis of Microarrays (SAM) approach (Tusher et al. (2001) Proc Natl Acad Sci USA 98, 5116-5121) was applied to corresponding transcriptome profiles. Significantly increased expression in k2 vs. k1 was noted for 111 (95 genes) of the 2210 probes mapping to chr1q (FDR=15%) (Table 4), and decreased expression in k2 versus k1 for 48 (46 genes) of the 1163 probes mapping to chr13 (FDR=15%) (Table 5). In both chr1q and chr13 cases, SAM-significant probes clustered in specific chromosomal bands. A test was therefore performed to determine whether subregions of chr1q and chr13 were significantly enriched for differentially expressed genes by counting significant genes in a 10-Mb moving-window, and testing for significance by permutation of gene position (Tonon et al. (2005) Proc Natl Acad Sci USA 102, 9625-9630). This approach revealed a marked enrichment in over-expressed genes residing at 1q21-q23, between approximately 143 and 158 MB (FIG. 3A, p<0.05), a region particularly notable as it encompasses two high-priority MCRs associated with poor survival (see below). The 1q genes up-regulated in the poor prognosis k2 subgroup included molecules encoding cancer-relevant activities (Table 4 and below). Analogous studies of chr13 showed significant enrichment of under-expressed genes residing at 13q14 between approximately 38 and 50 MB (FIG. 3B, p<0.05), a region known to sustain the highest frequency of LOH on chr13 in MM and including the RB1 gene (Elnenaei et al. (2003) Genes Chromosomes Cancer 36, 99-106). Within this region, comparison between gene expression in k1 and k2 groups identifies additional candidate tumor suppressor genes (Table 5; see below).

Molecular classification based on genomic features provided clear evidence that hyperdiploid MM is a genetically heterogeneous disease, and that a poor prognosis subset of hyperdiploid MM patients can be identified by the presence of chr1q gain and/or chr13 loss. The stratification of hyperdiploid MM into two outcome-correlated subclasses itself serves as strong validation of application of this gNMF algorithm for molecular classification of array-CGH profiles.

Figure 4:
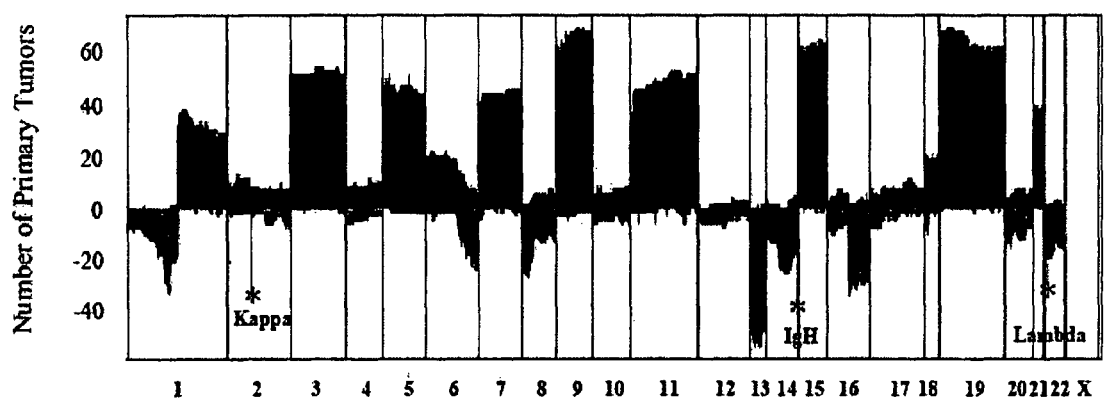
FIG. 4 depicts a summary of genomic profiles of MM. Recurrence of chromosomal alterations in primary MM tumors. Integer-value recurrence of CNAs across the samples in segmented data (y axis) is plotted for each probe evenly aligned along the x-axis in chromosome order. Dark red or green bars denote the number of samples with gain or loss of chromosome material, as defined in the Material and Methods section, and bright red or green bars represent the number of samples showing amplification or deletion (see Material and Methods). Asterisks show the focal deletions of the kappa (2p12), IGH (14q32) and lambda chain (22q11) loci physiological in B cell post-germinal center neoplasms.
Figure 6:
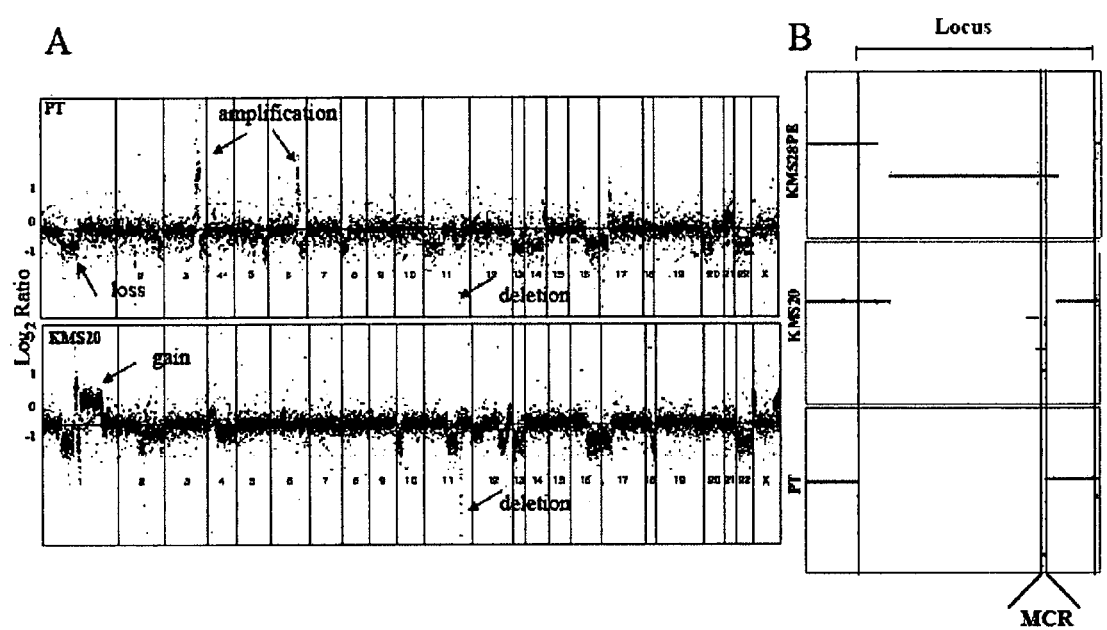
FIGS. 6A-B depict genomic profiles from Multiple Myeloma samples. (A). Wholegenome profiles of PT primary tumor (top) and KMS20 cell line (bottom). Array-CGH profiles with x-axis coordinates representing cDNA probes (top) or oligo probes (bottom) ordered by genomic map positions. Segmented data is displayed in red, median filtered (3 nearest neighbors) in black and raw data in green. Note presence of focal high-level amplifications and deletions as well as large regional gains and losses in both samples. (B). CGH profiles of 11q locus in three samples illustrating the definition of the physical extent and MCRs for that locus. Note that the MCR is defined by the overlap between samples on top and bottom. Since data points are plotted on the x-axis by genomic map positions, gaps in the profiles encompass regions of copy number transition for which there is no data point.

Recurrent and focal CNAs in the MM genome with potential biological and clinical significance. The high-definition picture of MM genomic alterations afforded an effective means to define recurrent CNAs with strong involvement in MM pathogenesis. The performance features of the array-CGH platforms (Brennan et al. (2004) Cancer Res 64, 4744-4748) and segmentation analysis (Aguirre et al. (2004) Proc Natl Acad Sci USA 101, 9067-9072; Tonon et al. (2005) Proc Natl Acad Sci USA 102, 9625-9630) readily identified large regional changes. The skyline recurrence plot (FIG. 4) mirrors well the frequencies of previously reported chromosomal gains of 1q, 3, 5, 7, 9, 11, 15, 19 and 21, and losses of 1p and 13 (Avet-Loiseau et al. (1997) Cancer 19, 124-133; Cigudosa et al. (1998) Blood 91, 3007-3010, 1998; Cremer et al. (2005) Genes Chromosomes Cancer 44, 194-203; Fonseca et al. (2004) Cancer Res 64, 1546-1558). In addition, these surveys also captured focal, recurrent, high amplitude CNAs present in both cell lines and primary tumor specimens (FIG. 6A). Analysis of 358 distinct CNAs across the MM tumor collection (n=67) and MM cell lines collection (n=43) delimited 298 minimal common regions (MCRs) (FIG. 6B), which were further filtered down to 87 prioritized MCRs based on the criteria of presence in primary tumors and occurrence of at least one high amplitude event (log 2 ratio>0.8). These 87

Figure 8:
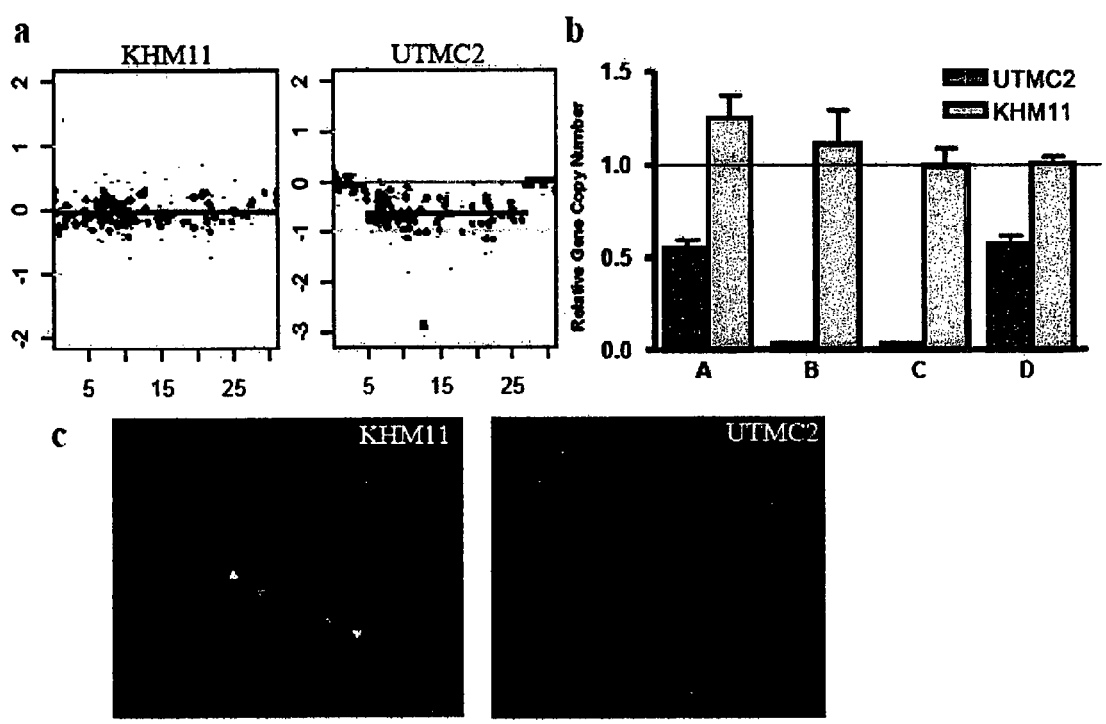
FIG. 8A-C depict QPCR and FISH verification of CDKN1B micro deletion. Chromosome 12 array-CGH profile (A) for a CNA in the UTMC2 cell line containing a homozygous deletion of the known target CDKN1B as confirmed by QPCR (B) and FISH analysis (C) using a control BAC (green) and a BAC probe spanning the CDKN1B gene (red; arrowhead). KHM11 control cell line showing signals for the BAC spanning CDKN1B (left panel) and UTMC2 cell line with no signal for the BAC spanning CDKN1B (right panel).

MCRs comprised of 47 amplifications (Table 1) and 40 deletions (Table 2), spanning a median size of 0.89 Mb with an average of 12 known genes. That these 'high priority' MCRs possess high disease relevance is reflected by (i) consistent verification by realtime quantitative PCR (QPCR) in all randomly assayed high-priority MCRs and by FISH in selected cases (Tables 1 and 2, bold; FIGS. 7 and 8), and (ii) inclusion of all signature MM loci of known pathogenetic relevance such as deletion of a region including the TP53 tumor suppressor and focal amplifications of areas including the hepatocyte growth factor (HGF) and the MYC and ABL1 oncogenes.

Integrated copy number and expression analysis identified known and potential cancer genes in MM pathogenesis. As the copy number alteration mechanism serves to drive altered expression of the resident genes (Aguirre et al. (2004) Proc Natl Acad Sci USA 101, 9067-9072; Platzer et al. (2002) Cancer Res 62, 1134-1138; Tonon et al. (2005) Proc Natl Acad Sci USA 102, 9625-9630), an integrated RNA expression analyses was conducted by the Gene-Weight measure as described previously (Aguirre et al. (2004) Proc Natl Acad Sci USA 101, 9067-9072; Hyman et al. (2002) Cancer Res 62, 6240-6245). First, for each gene residing within an amplified MCR, it was asked whether its expression showed a copy number correlated pattern by comparing the mRNA levels in tumors with and without CNAs in the region of interest. In addition, modeling after bona fide oncogenes, such as Myc, whose expressions are known to be dysregulated by mechanism(s) other than gene dosage alteration, a comparison was made of the expression of the gene in tumors with or without CNAs, relative to normal plasma cells, respectively (See Materials and Methods in Example 1A). Genes showing this "oncogene-like" expression pattern—namely copy number correlated expression and significant overexpression in tumors without amplification vs. normal plasma cells—were considered high-probability candidates targeted for amplification in these MCRs during MM development.

By such stringent criteria, approximately 30% of the 2151 genes residing in the highpriority MCRs were considered strong candidates. These included genes with prominent and credentialed roles in MM pathogenesis such as MYC, MCL1, IL6R, HGF, and ABL1 (Table 1), as well as many functionally diverse genes with no known link to MM development. Several E3 ubiquitin ligase genes are provided as one embodiment of the invention, including the anaphase promoting complex subunit 2 (ANAPC2), F-box protein 3 (FBXO3), F-box protein 9 (FBXO9), SMAD-specific E3 ubiquitin protein ligase 2 (SMURF2), and huntingtin interacting protein 2 (HIP2). The merged amplification/expression data also reveals significant representation of molecular chaperones including chaperonin containing TCP1, subunit 3 (gamma) (CCT3), Der1-like domain family, member 1 (DERL1), DnaJ (Hsp40) homolog, subfamily C, member 1 (DNAJC1), and the co-chaperone adaptor (CDC37) whose enforced expression has been shown to be oncogenic in transgenic mice (Stepanova et al., 2000). A deregulation of many genes linked to ribosome biogenesis and protein synthesis including the ribosomal protein encoding genes RBM8A and RPL18 among many others, and the translational control gene (EEF2) (Table 1).

High-priority MCRs define loci with biological and prognostic relevance. To determine whether any of the high-priority MCRs (Tables 1 and 2) possessed prognostic relevance, survival for MM cases harboring a specific MCR versus those without the MCR was compared by Kaplan-Meier analyses. The presence or absence of a particular MCR was correlated with outcome, without taking into consideration the gNMF subclass assignment of the MM samples. This straightforward correlation identified 14 MCRs associated with poor survival (hereafter designated as PS-MCR for "poor-survival" MCR) (Table 1, diamonds). This PS-MCR list included an amplification on chr8 (including MYC) and a deletion on chr17 (including TP53), two genetic events that have been linked previously to poor prognosis in MM (Kuehl and Bergsagel (2002) Nat Rev Cancer 2, 175-187).

Of the other three amplified PS-MCRs, one resided in the critical chr1q region and two resided in novel MM loci. The first novel amplified PS-MCR defined a chr8q24 region spanning 6 Mb with 37 genes (distinct from MYC) and was notable for its association with a poor clinical outcome and tumor recurrence in other human cancer types (Tonon et al. (2005) Proc Natl Acad Sci USA 102, 9625-9630; van Duin et al. (2005) Cytometry A 63, 10-19). Among the seven genes showing oncogene-like expression pattern are DEPDC6 and FBXO32. The second novel amplified PS-MCR targets a chr20q region spanning 4 MB with 43 genes that has been associated with disease progression and increased metastases in prostate cancer (Wullich et al. (2004) Cancer Genet Cytogenet 154, 119-123), esophageal squamous cell carcinoma and gastric and colorectal adenocarcinoma (Fujita et al. (2003) Hepatogastroenterology 50, 1857-1863). In this amplicon resides PPIA (Cyclophilin A) which functions as a paracrine and autocrine modulator of endothelial cells proliferation, migration and invasive capacity (Kim et al. (2004) Am J Pathol 164, 1567-1574) (see discussion).

Among the 10 deleted PS-MCRs, four highly discrete regions mapped to chr1p within a much larger less defined region implicated in MM prognosis based on FISH analyses (Panani et al. (2004) Anticancer Res 24, 4141-4146). Two of these contains only 4 resident genes including DFFA (DNA fragmentation factor, 45 kDa, alpha polypeptide), which is a key substrate for caspase-3 that triggers DNA fragmentation during apoptosis (Table 2). The remaining deletion PS-MCRs includes three on chr16, two on chr17, one of them harboring TP53 (Table 2) and two on chr20. Among these, the 16q12 region spanning 7.7 MB with 45 genes includes the tumor suppressor CYLD (see below). The 16q13 region contains only 5 genes: G protein-coupled receptor 56, G protein-coupled receptor 97, two genes encoding the centrosomal proteins KATNB1 and KIFC3 and the hypothetical protein encoding gene C16orf50. Finally, chr17p13.3-17p13.2 locus spanning 1.49 MB with 43 genes includes several prime tumor suppressor candidates such as TAXIBP3, a gene inhibiting Wnt/β-catenin signaling pathway (Kanamori et al. (2003) J Biol Chem 278, 38758-38764), and GSG2, encoding a kinase required for mitotic histone H3 Thr 3 phosphorylation and normal metaphase chromosome alignment (Dai et al. (2005) Genes Dev 19, 472-488).

Figure 1:
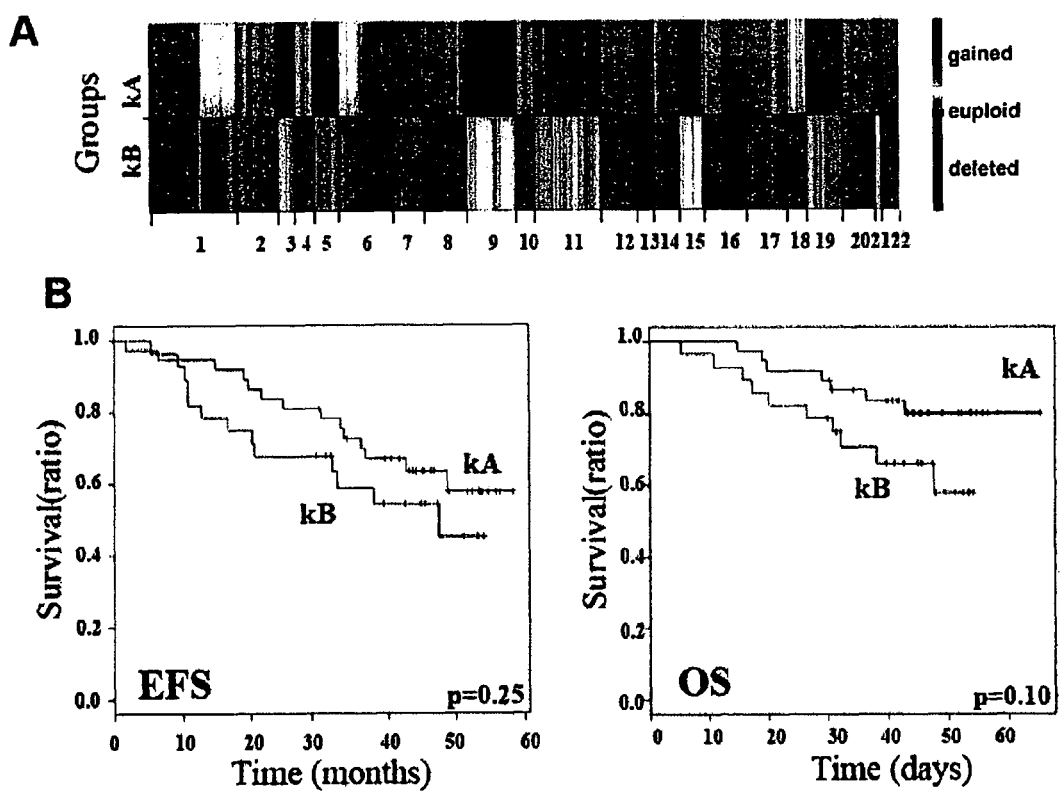
FIGS. 1A-B depict a gNMF classification wherein rank K=2, identifies two subgroups, kA and kB, reminiscent of the MM hyperdiploid/non-hyperdiploid subgroups. (A). The aCGH profiles of 67 clinically annotated primary tumors were subjected to NMF analyses (1000 repetitions). With rank k=2, two distinct subgroups kA and kB were identified (y axis) and the centroids of each group are shown. The x-axis coordinate represents genomic map order (from chr1 to chr22). The colors denote gain (red), euploid (yellow/green) or deleted (blue) chromosome material. (B). Kaplan-Meier event-free-survival (EFS; left) and overall survival (OS; right) curves for 64 MM patients demonstrate no significant difference in survival (p=0.25 and 0.1 respectively) when divided into subgroups kA vs. kB.
Figure 2:
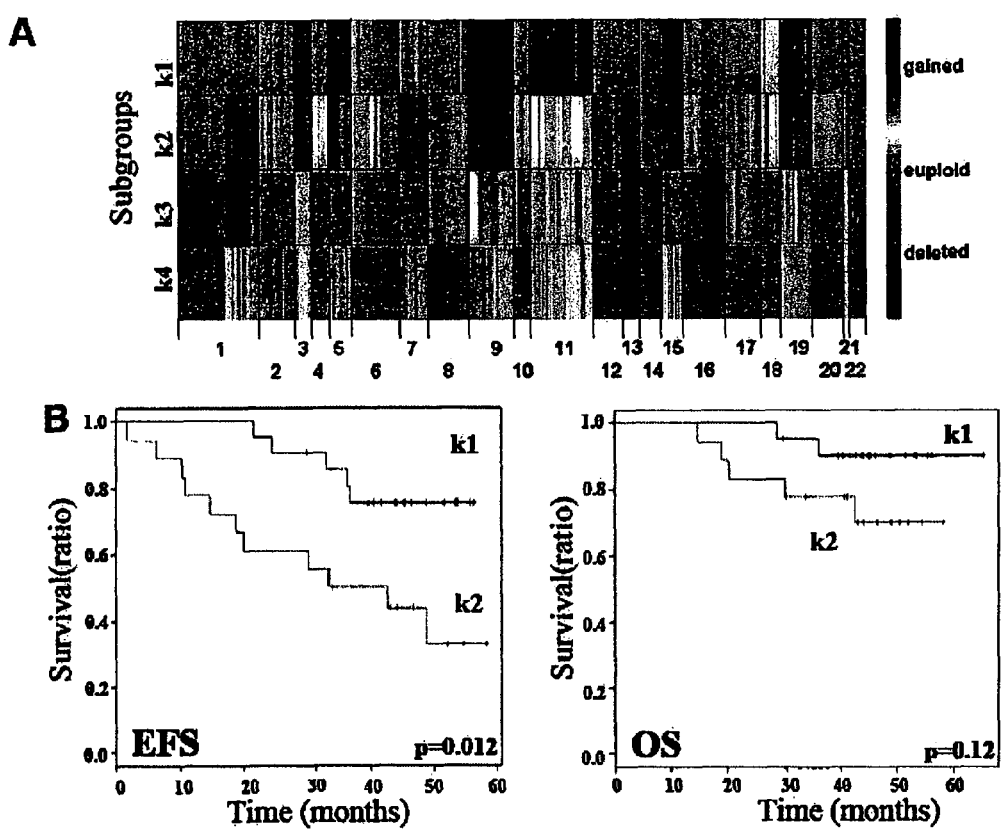
FIGS. 2A-B depict a gNMF classification wherein rank K=4 identifies 4 distinct subgroups (A). The aCGH profiles of 67 clinically annotated primary tumors were subjected to NMF analyses (1000 repetitions). y-axis indicates the 4 subgroups identified by NMF. The x-axis coordinate represents genomic map order (from chr1 top chr22). The colors denote gain (red), euploid (yellow/green) or deleted (blue) chromosome material. (B). Kaplan-Meier event-free-survival (EFS; left) and overall survival (OS; right) curves for 64 mM patients for k1 and k2 subgroups. k1 shows significantly better event-free-survival than k2 (p=0.012) while OS did not reach statistical significance (p=0.12).

Distinct molecular subclasses linked to disease pathogenesis and prognosis. This study demonstrated that embedded within the array-CGH profiles are biologically significant patterns of genomic alterations. gNMF with rank of K=2 divided the MM primary tumors into kA vs. kB subgroups corresponding to the traditional hyperdiploid and nonhyperdiploid groups, respectively (FIG. 1). Although the lack of a significant outcome difference between these two subgroups may relate to sample size and/or time of clinical follow up (median 43 months), the fact that further stratification with rank K=4 resulted in distinct subclasses with differences in clinical outcome (FIG. 2) indicates that the more likely explanation relates to inherent heterogeneity within the previously defined hyperdiploid and nonhypderdiploid groups. Indeed, when hyperdiploid MM cases were stratified into two subclasses, k1 and k2, a clear survival advantage was observed among patients in the k1 group (FIG. 2), which was characterized by presence of chr11 gain and absence of chr1q gain or chr13 loss. Importantly, by reducing the k1 vs k2 classifier to presence/absence of chr1q and chr13 alterations determined by FISH in hyperdiploid MM (i.e. tumor samples with odd-chromosome gain pattern as determined by average of gene expression values across chromosomal arms), able to validate the prognostic difference of k1 and k2 was validated in an independent cohort of 135 outcome-annotated TT2 treated MM cases (Barlogie et al. (2006) N Engl J Med in press. (data not shown). A further validation of the biological significance of k1 and k2 subclasses was provided by Gene Set Enrichment Analysis (Monti et al. (2005) Blood 105, 1851-1861) of the transcriptomes, revealing perturbation of distinct cancer-relevant pathways in each subclass. While TP53, KRAS, FRAP1 (FK506 binding protein 12-rapamycin associated protein 1), and the proteasome (data not shown) pathways were altered in both subgroups, dysregulation of additional cancer-relevant pathways, such as sonic-hedgehog and RAC1 (Mitsiades et al. (2004) Cancer Cell 6, 439-444; Qiang et al. (2005) Blood 106, 1786-1793), was observed only in k2 samples, suggesting a more advanced stage in the evolution of MM.

To identify key genes within chr1q or chr13 that may dictate clinical behavior of hyperdiploid MM, gene expression data was integrated with copy number profiles to generate a short list of strong candidates (Tables 4 and 5). Among the 1q genes up-regulated in k1 vs. k2 are many novel candidates not previously linked to MM or more generally to cancer, such as genes affecting survival and proliferation (SHC1, S100A2, HDGF) (Emberley et al. (2004) Biochem Cell Biol 82, 508-515; Magrassi et al. (2005) Oncogene 24, 5198-5206), hypoxia (ARNT) (Maina et al. (2005) Oncogene 24, 4549-4558), and cell adhesion and motility (MAPBPIP) (Pullikuth et al. (2005) Mol Cell Biol 25, 5119-5133; Titus et al. (2005) Crit. Rev Eukaryot Gene Expr 15, 103-114) (Table 4). Regarding chr13 deletion, most reported cases show loss of the entire chromosome, although ~15% of MM patients sustain more focal deletion or LOH targeting chr13q14 (Elnenaei et al. (2003) Genes Chromosomes Cancer 36, 99-106). An integrated RNA-DNA analysis was able to narrow the region of interest to a 10 MB region on chr13q14, encompassing some interesting candidates. RB1 was included in this region, however its role in MM has been questioned even in advanced MM and cell lines (Kuehl and Bergsagel (2002) Nat Rev Cancer 2, 175-187; Shaughnessy et al. (2003) Immunol Rev 194, 140-163). Among the down-regulated genes within this region are several putative tumor suppressor genes, such as FOXO1a (Medema et al., 2000), DNAJD1 (Lindsey et al. (2005) Int J Cancer), CHC1L (Lindsey et al. (2005) Int J Cancer) as well as RFP2, a gene with homology to BRCA1 and implicated in CLL (van Everdink et al. (2003) Cancer Genet Cytogenet 146, 48-57) (Table 5). Note that RFP2 was recently identified as the only gene from chr13 whose reduced expression was highly correlated with poor outcome in a genome wide expression profiling study in MM. While integration of expression and copy number provides an effective means to convert genomic features into candidate genes, it should be stated that such genome-anchored analysis will preferentially capture genes whose dysregulation and involvement in MM are driven by copy number aberrations, while missing other MM-relevant genes that are predominantly regulated by other mechanisms.

MCRs harbor candidate genes of biological and clinical relevance. It should be noted that the genomic approach primarily emphasized regions and genes within defined MCRs, and therefore genes residing outside of MCRs that might be related to prognosis would not be captured by this analysis. Interestingly, the MM genome shared many CNAs with other histologically unrelated cancers such as pancreas, lung, breast and ovary, suggesting common mechanisms of disease pathogenesis (Aguirre et al. (2004) Proc Natl Acad Sci USA 101, 9067-9072; Cheng et al. (2004) Nat Med 10, 1251-1256; Tonon et al. (2005) Proc Natl Acad Sci USA 102, 9625-9630). Also, several known hotspots for proviral integration and/or chromosomal rearrangement targeting pathogenetic loci were located within high-priority MCRs (Tables 1 and 2) (Collier et al. (2005) Nature 436, 272-276).

The integration of copy number changes and gene expression information (using bone marrow derived plasma cells as reference) enabled significant reductions in the number of candidate oncogenes residing within the high-priority MCR amplicons. The reliability of this approach is confirmed by the ability of this algorithm to successfully sift established oncogenes from surrounding, likely bystander genes. For instance, HGF was located within a small MCR including 4 genes and was found to be the only gene with such an oncogene-like expression pattern. It should be noted that microRNAs embedded within the MCRs could also exert an oncogenic role, as recently demonstrated (He et al. (2005) Nature 435, 828-833). Indeed, 20% of the 87 high priority MCRs contain microRNAs that could therefore represent potential targets of the CNAs.

Among candidates from other MCRs exhibiting the oncogene-like expression pattern are key components of several cancer-relevant pathways (Table 1). The amplification and overexpression of E3 ubiquitin ligases (ZNF364, RNF13, FBXO3, FBXO9, FBXO32, SMURF2 and HIP2) and two DEAD box proteins (DEAD disclosed as SEQ ID NO: 713) on chr11 (DDX6) and chr17 (DDX5) are intriguing given the critical role of the ubiquitin-proteasome pathway in auditing the levels of key cell cycle and apoptosis control proteins (Castro et al. (2005) Oncogene 24, 314-325; Nakayama and Nakayama (2005) Semin Cell Dev Biol 16, 323-333) and the proposed role of human RNA helicases in various types of cancer (Abdelhaleem, M. (2004) Biochim Biophys Acta 1704, 37-46). Interestingly, in the amplified PS-MCR on chr20, among the genes showing an oncogene-like expression pattern, there was PPIA (Cyclophilin A) which functions as a paracrine and autocrine modulator of endothelial cell proliferation, migration and invasive capacity (Kim et al. (2004) Am J Pathol 164, 1567-1574). This is a notable observation in light of the strong association between robust bone marrow angiogenesis and active MM disease, disease progression and adverse prognosis (Giuliani et al. (2004) Hematology 9, 377-381). The immunosuppressive drug cyclosporine forms a complex with PPIA that inhibits calcineurin, a serine/threonine phosphatase (Colgan et al. (2005) J Immunol 174, 6030-6038). PPIA could therefore represent a gene potentially important for MM progression and, at the same time, a target for which an effective compound blocking its activity is already available.

Among the tumor suppressor genes (TSGs), TP53 resided in an MCR that was also linked to poor prognosis, confirming previous reports (Bergsagel and Kuehl (2005) J Clin Oncol 23, 6333-6338). Interestingly, TP53 was generally overexpressed (data not shown), a finding consistent with the known compensatory up regulation of mutant p53 (Furubo et al. (1999) Histopathology 35, 230-240). CDKN2C and CDKN1B, often deleted in MM (Bergsagel and Kuehl (2005) J Clin Oncol 23, 6333-6338; Filipits et al. (2003) Clin Cancer Res 9, 820-826), were not included in the high-priority MCR list since the segmentation algorithm discards CNAs identified by single probes in exchange for an improved falsepositive rate (Aguirre et al. (2004) Proc Natl Acad Sci USA 101, 9067-9072), however, they were recurrently lost in the raw CGH profiles (FIG. 8A). As expected, CDKN2A and PTEN did not show copy number losses, usually inactivated in MM through promoter methylation and point mutations, respectively (Chang et al. (2005) Leuk Res; Urashima et al. (1997) Clin Cancer Res 3, 2173-2179). Among bona fide and putative TSGs not previously linked to MM, there were BCL11B, DYRK1B, GLTSCR1, ST7L and SPARCL1 (Isler et al. (2004) Int J Oncol 25, 1073-1079; Katoh, M. (2002) Int J Oncol 20, 1247-1253; Smith et al. (2000) Genomics 64, 44-50). Of particular therapeutic relevance is the presence of CYLD within one PS-MCR on chr16. CYLD is a tumor suppressor gene with an established role in NF-kB signaling and a genetic link to cylindromatosis (Brummelkamp et al. (2003) Nature 424, 797-801). Since CYLD and Aspirin have a similar inhibitory effect on NF—B levels, although they act at different points in the pathway, treatment with Aspirin has been proposed for these cylindromatosis patients (Lakhani, S. R. (2004) N Engl J Med 350, 187-188). While the relevance of CYLD as a tumor suppressor gene in MM remains to be established, such observations prompt speculation that high-dose Aspirin may be useful to consider in the clinical management of the subset of patients presenting with this genomic lesion.

Example 2

A. Materials and Methods

As described herein, triangulation of genomic, expression and clinical information in a cohort of MM samples has generated a list of high-value oncogene candidates. To validate the role of these gene candidates in oncogenesis, a number of general cancer-related cell-based assays was employed. First, RNAi-mediated knockdown was carried out in established MM cells with documented overexpression to determine the essentiality of candidate gene expression for oncogenic activities. In vitro proliferation and soft-agar formation was then utilized, as loss-of-function assays. Second, mindful of potential caveats of using established tumor cells, these loss-of-function were complemented with experiments with gain-of-function assays in relatively naïve cells. Specifically, whether overexpression of the candidate genes drives the in vitro transformation in MEF or enhances IL3-independent survival in Ba/F3 cells was observed. Candidates exhibiting activities in both loss-of-function and gain-of-function assays were considered to be validated oncogenes.

Figure 10A:
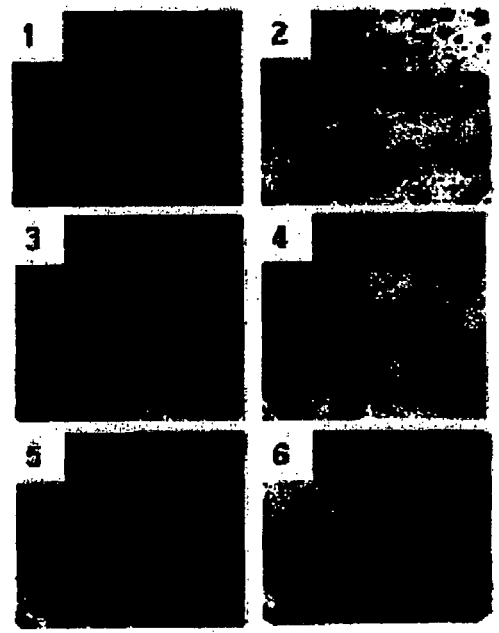
FIGS. 10A-B shows that candidate genes in combination with H-RAS$^{G12v}$ induce focus formation in MEF cells. 1-RAS alone as a negative control; 2-RAS+MYC as a positive control; 3-RAS+DHX36; 4-RAS+SEMA4A; 5-RAS+GPR89; and 6-RAS+PRKCi.
Figure 10B:
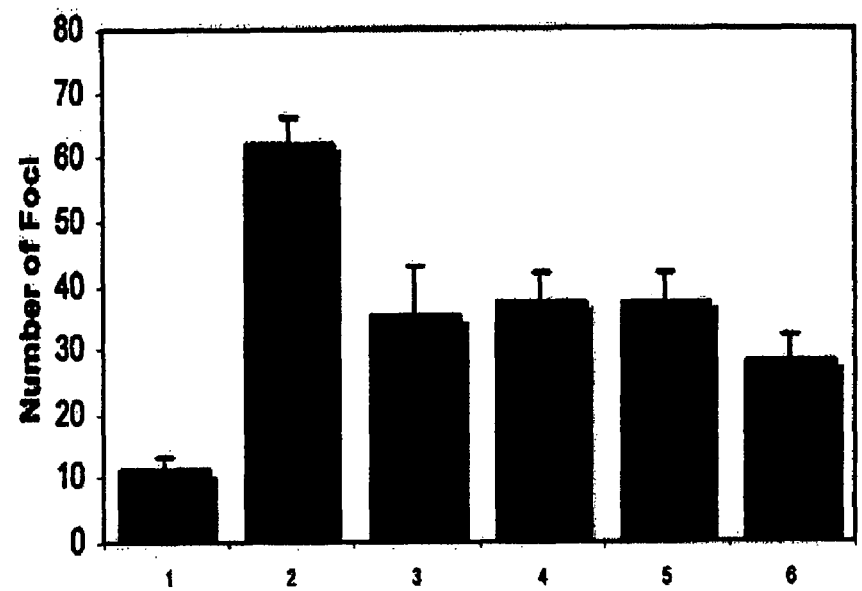

The colony formation in MEF cells induced by four candidate genes, DHX36, SEMA4A, GPR89, and PRKCi, in at least four replicate experiments, was assessed. Results demonstrated a 1.5-fold or greater increase in focus formation in In4a/Arf-/- MEF in cooperation with RAS for all four of genes of interest (FIGS. 10A-B).

Figure 11:
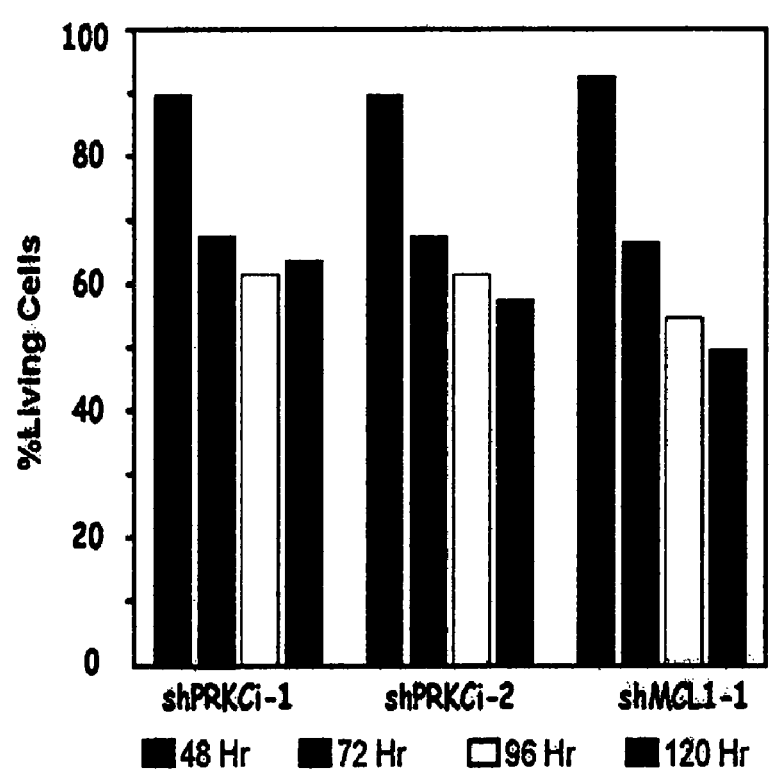
FIG. 11 shows that cell survival after shRNA knockdown of PRKCi is comparable to that of shRNA knockdown of positive control MCLI. Two effective shRNAs were used against PRKCi.
Figure 12:
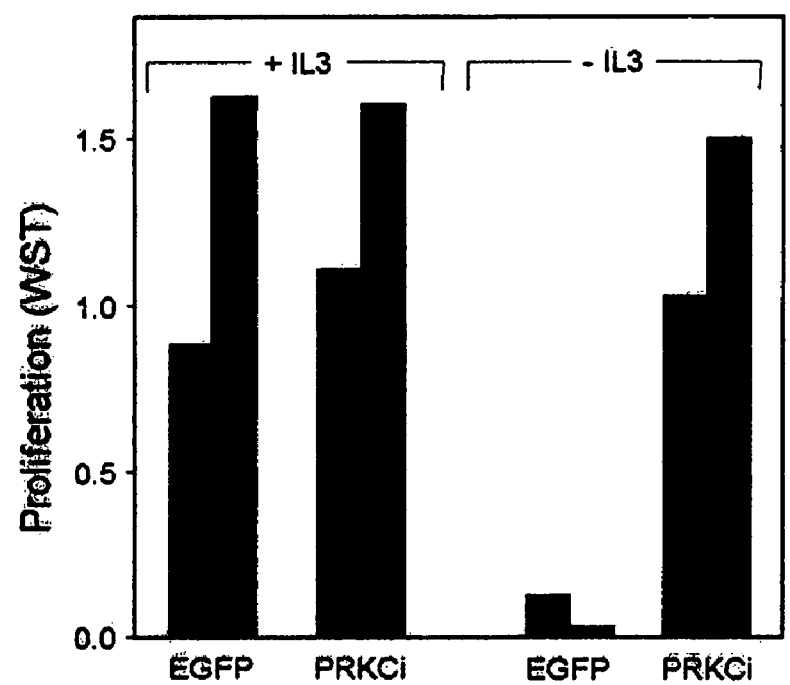
FIG. 12 shows that over expression of PRKCi in BaF3 cells confers IL-3 independent growth and survival. PRKCi expressing cells did equally well in the presence or absence of IL3. Light=48 hrs; Dark=96 hrs.

PRKCi. Loss-of-function studies with two gene-specific short-hairpin RNAs (shRNAs) (each displaying greater than 80% expression knock down) led to 40% reduction in proliferation of the tested MM cell line (FIG. 11), comparable to the effects observed with an MCL1 knockdown. In gain-of-function experiments, over-expression of PRKCi conferred IL3 independent growth and survival to Ba/F3 pro-lymphoma mouse cells, as well as formed more and larger transformed foci in cooperation with RAS in Ink4a/Arf-/- MEFs (FIG. 12).

Figure 13:
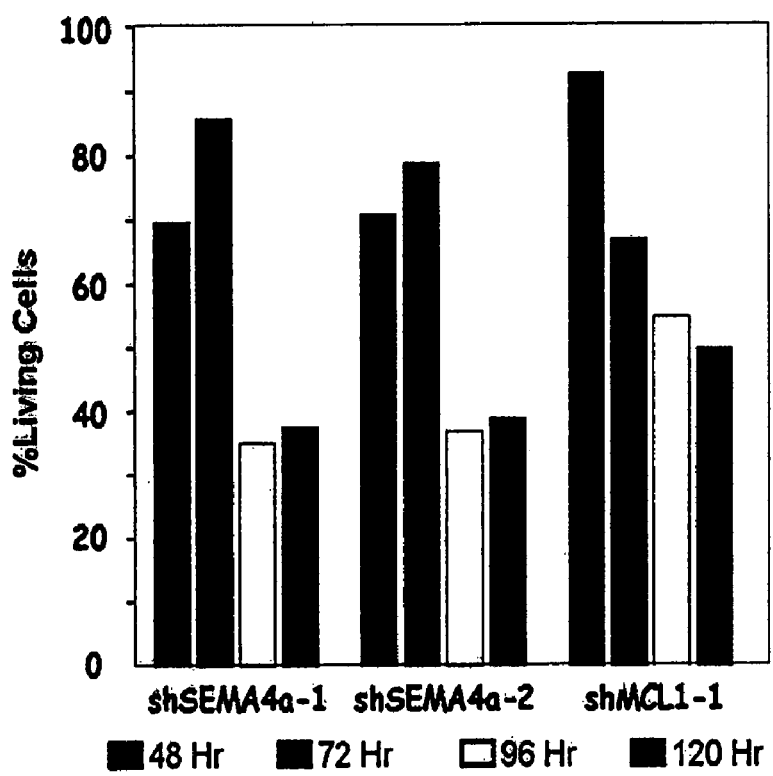
FIG. 13 shows that cell survival after shRNA knockdown of SEMA4A with two effective shRNAs is more significant than that observed with shRNA knockdown of MCL1.
Figure 14:
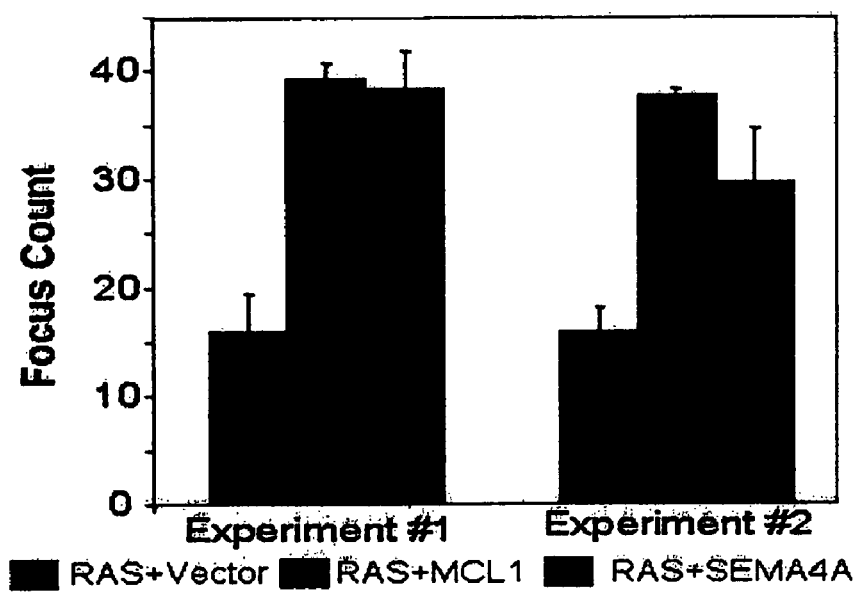
FIG. 14 shows that in an MEF cooperation assay, SEMA4A+RAS have increased focus formation by about 2 folds relative to vector control in two experiments, comparable to the effect of MCL1 in two experiments.
Figure 15A:
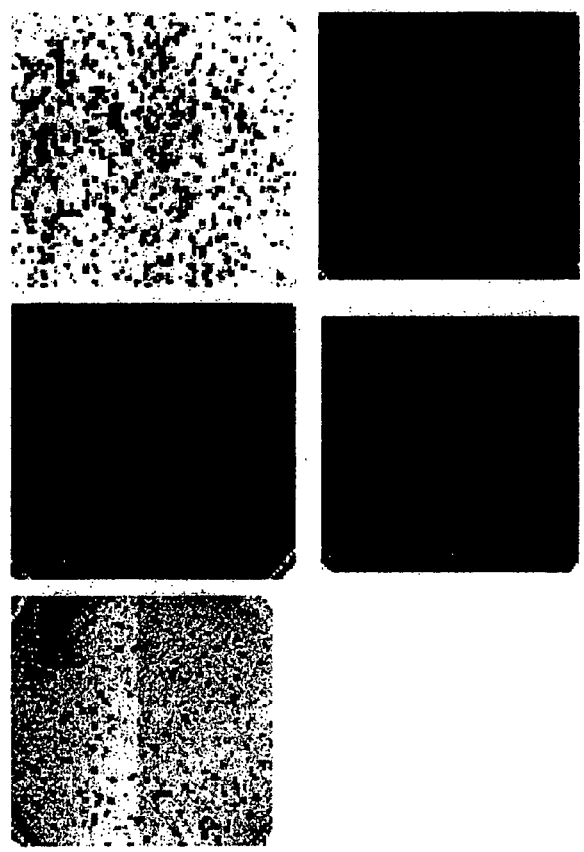
FIG. 15A-B depicts that knockdown of SEMA4A and PRKCi by lentiviral shRNA resulted in a marked inhibition of cell growth by day 3. 1-shGPR; 2-shPRKCi-1; 3-shPRKCi-5; 4-shSEMA4A-1; and 5-shSEMA4A-5.
Figure 15B:
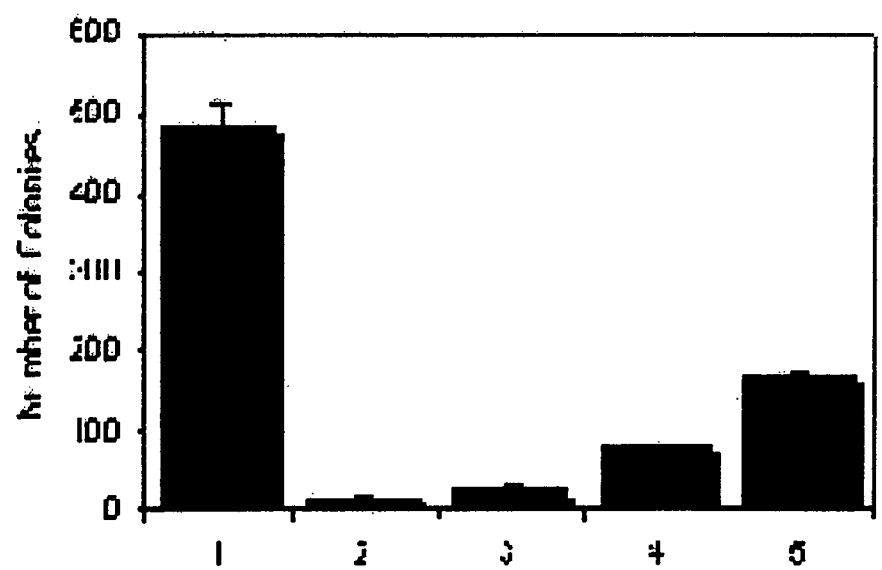

SEMA4A. It was shown that shRNA-knockdown of SEMA4A (with two independent shRNAs proven to be effective; data not shown) resulted in more dramatic inhibition of survival of OPM1 MM cells than that observed with MCL 1 knockdown (FIG. 13). In addition, overexpression of SEMA4A resulted in more than 1.5-fold increase in focus formation in In4a/Arf-/- MEF in cooperation with RAS, comparable to effect of MCL1 (FIG. 14).

Figure 16:
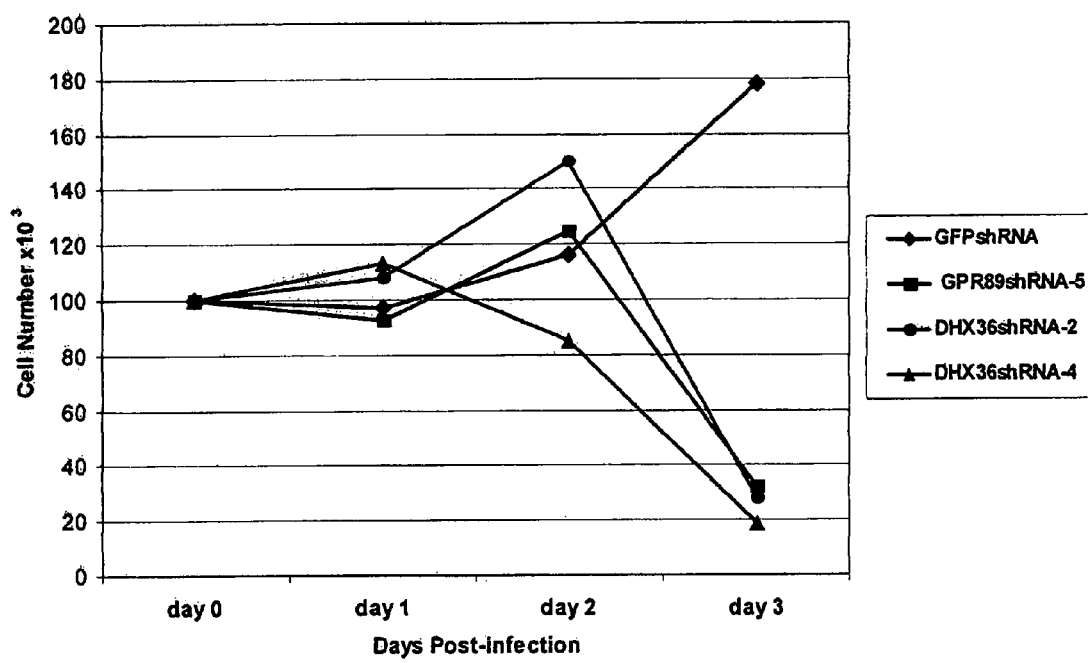
FIG. 16 depicts the effects of GPR89 and DHX36 knockdown on RPMI 8226 cell (MM origins) growth.

GPR89 and DHX36. Multiple Myeloma cell line DHX36 was used for a loss-of-function assay with two other candidate genes: GPR89 and DHX36. The knock down of these genes by lentiviral shRNAs resulted in a marked inhibition of cell growth by day 3. (FIG. 16).

B. Results

Based on the above data it was concluded that all four genes: PRKCi, SEMA4A, DHX36 and GPR89 are markers in MM and possess oncogenic qualities. The following further describes what has been known about these markers.

SEMA4A (gene ID#64218, Chr1q22) SEMA4A is a member of the semaphorin family of soluble and transmembrane proteins. Semaphorins are involved in guidance of axonal migration during neuronal development and in immune responses.

Although semaphorins were identified originally as guidance cues for developing neuronal axons, accumulating evidence indicates that several semaphorins are expressed also in the immune system. SEMA4A, which is expressed by dendritic cells (DCs), is involved in the activation of T cells through interactions with TIM2. SEMA4A is thought to function in the reciprocal stimulation of T cells and antigen-presenting cells. (Kumanogoh, A. (2003) Nat. Rev. Immunol. 2, 159-67).

Class IV semaphorin Sema4A, which is expressed in DCs and B cells, enhances the in vitro activation and differentiation of T cells and the in vivo generation of antigen-specific T cells. Treating mice with monoclonal antibodies against Sema4A blocks the development of an experimental autoimmune encephalomyelitis induced by an antigenic peptide derived from myelin oligodendrocyte glycoprotein. (Kumanogoh, A., et al. (2002) H. Nature. 419 6907, 629-33).

US2004/0052782 describes a costimulatory pathway mediated by SEMA4A, which is selectively expressed on the surface of dendritic cells. In addition, the use of SEMA4A protein and protein derivatives in a method for the identification of immunomodulatory substances is described.

PRKCi (Gene ID#5584, Chr 3q26.3)

The protein encoded by PRKCi belongs to the protein kinase C (PKC) family of serine/threonine protein kinases. The PKC family comprises at least eight members, which are differentially expressed and are involved in a wide variety of cellular processes. PKC-iota (PKCi) is classified as an atypical protein kinase C isoform, that is calcium-independent and phospholipid-dependent. It is not activated by phorbolesters or diacylglycerol. This kinase has been shown to be recruited to vesicle tubular clusters (VTCs) by direct interaction with the small GTPase RAB2, where this kinase phosphorylates glyceraldehydes-3-phosphate dehydrogenase (GAPD/GAPDH) and plays a role in microtubule dynamics in the early secretory pathway. This kinase is found to be necessary for BCL-ABL-mediated resistance to drug-induced apoptosis and therefore protects leukemia cells against drug-induced apoptosis.

PKC-iota has been implicated in ovarian cancers (Eder, A. M., (2005) Proc Natl Acad Sci USA. 102(35):12519-24), NSLCC (Regala, R. P., NSLCC (2005) J Biol. Chem. 280 (35):31109-15) and colon (Murray, N. R., (2004) J. Cell Biol. 164(6):797-802) and plays an important role in regulating cell survival in tumor cells. (Grunicke, H. H., (2003) Adv Enzyme Regul. 43:213-28).

DHX36 (Gene ID#170506, Chr 3q25)

DHX36 encodes a DEAD box protein (DEAD disclosed as SEQ ID NO: 713), characterized by the conserved motif Asp-Glu-Ala-Asp (DEAD) (SEQ ID NO: 713), and is a putative RNA helicase. RNA helicases are implicated in a number of cellular processes involving alteration of RNA secondary structure such as translational initiation, nuclear and mitochondrial splicing, and ribosome and spliceosome assembly. Based on their distribution patterns, some members of this DEAD box protein (DEAD disclosed as SEQ ID NO: 713) family are believed to be involved in embryogenesis, spermatogenesis, and cellular growth and division.

It has been shown that the DHX36 helicase plays major role in tetramolecular quadruplex G4-DNA resolvase activity. (Vaughn, J. P., (2005) J. Biol. Chem., Vol. 280, Issue 46, 38117-38120). There is also increasing evidence that these four-stranded Hoogsteen-bonded DNA structures, G4-DNA, play an important role in cellular processes such as meiosis and recombination. (Harrington, C., 1997 Sep. 26, The American Society for Biochemistry and Molecular Biology, Inc. Volume 272, pp. 24631-2463610). G4-DNA structures are located at telomeres and genetic control elements such as the promoters of c-MYC, PDGF-A, RET, Ig HCS region, and others.

GPR89 (Gene ID#51463, Chr 1p36.13-q31.3)

GPR89, also referred to as the G protein-coupled receptor 89A, has been shown to activate the NFkB and MAPK signaling pathways (Matsuda, A., (2003) Oncogene 22 (21): 3307-18) which play important role in oncogeneisis.

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

Also incorporated by reference in their entirety are any polynucleotide and polypeptide sequences which reference an accession number correlating to an entry in a public database, such as those maintained by The Institute for Genomic Research (TIGR) on the world wide web at tigr.org and/or the National Center for Biotechnology Information (NCBI) on the world wide web at ncbi.nlm.nih.gov.

EQUIVALENTS

Those skilled in the art will recognize, or be able to ascertain using no more than routine experimentation, many equivalents to the specific embodiments of the invention described herein. Such equivalents are intended to be encompassed by the following claims.

TABLE I

| | | | | | | |
|---|---|---|---|---|---|---|
| | | | | Gains and Amplifications. | | |
| Cytogenetic Band | MCR Boundary (Mb) | MCR size (Mb) | Known Genes | Candidate Genes | Integration Sites | miRNA |
| 1q21.1-1q22 ◆ | 142.60-153.23 | 10.64 | 231 | MCL1, IL6R, PSMD4, PSMB4, UBE2Q, UBAP2L, RBM8A, RPS27, PIAS3, POLR3C, HIST2H2AA, LASS2, MRPL9, JTB, HAX1, SHC1, APH-1A, BCL9, ZNF364, GPR89, SEMA4A | Dkmi7, Rorc, NKI-6, Dkmi8 | |
| 1q22 | 152.73-153.27 | 0.53 | 21 | SSR2, MAPBPIP, CCT3, MEF2D, C1orf85 | Evi53 | hsa-mir-9-1 |
| 1q43-1q44 | 236.73-245.42 | 8.69 | 94 | FH, HNRPU, TFB2M | | |
| 2p25.1 | 11.35-11.68 | 0.33 | 3 | | | |
| 2p16.1 | 55.68-56.01 | 0.32 | 4 | SMEK2, MGC15407 | | |
| 2q35 | 219.08-219.44 | 0.36 | 11 | BCS1L | | hsa-mir-26b |
| 3q25 | 147.32 159.53 | 12.21 | | DHX36 | | |
| 3q 26.3 | 170.97 172.80 | 1.84 | | PRKCi | | |
| 3q27.1-3q27.2 | 185.53-187.13 | 1.60 | 19 | POLR2H, EIF4G1 | | |
| 4p14-4p12 | 39.60-48.73 | 9.12 | 45 | HIP2, SCC-112, OCIAD1, RHOH, UCHL1, TMEM33 | | |
| 4q22.3-4q24 | 95.84-104.04 | 8.20 | 35 | PPP3CA, H2AFZ, SLC39A8 | Evi157 | |
| 5p12 | 42.76-43.16 | 0.41 | 5 | | Evi124 | |
| 5q12.1-5q13.2 | 60.24-68.59 | 8.35 | 37 | | | |
| 5q13.2-5q13.3 | 73.12 76.06 | 2.94 | 19 | TINP1, HMGCR, COL4A3BP, POLK | Evi19 | |
| 5q14.1 | 77.48-79.97 | 2.49 | 20 | SCAMP1, ARSB, JMY, MTX3, PAPD4 | | |
| 5q31.3 | 140.55-140.66 | 0.11 | 10 | PCDHB10 | | |
| 6p21.32 | 32.03-32.20 | 0.17 | 12 | RDBP, STK19 | | |
| 6p21.1 | 45.99-53.24 | 7.25 | 53 | CD2AP, MUT, FBXO9, TFAP2B, TMEM14A, ICK, ELOVL5 | | hsa-mir-(206, 133b) |
| 6q13-6q14.1 | 70.16-76.17 | 6.01 | 27 | TMEM30A | | hsa-mir-(30c-2, 30a, 30a-5p) |
| 7p14.3 | 30.89-33.74 | 2.85 | 2 | LSM5, FKBP9, NT5C3, PTHB1, KBTBD2, RP9 | | |
| 7q21.11 | 79.93-81.24 | 1.30 | 4 | HGF | | |
| 7q21.12 | 86.03-87.18 | 1.15 | 11 | MCFP, DMTF1, ASK, TP53AP1 | | |

TABLE I-continued

Gains and Amplifications.

| Cytogenetic Band | MCR Boundary (Mb) | MCR size (Mb) | Known Genes | Candidate Genes | Integration Sites | miRNA |
|---|---|---|---|---|---|---|
| 7q32.1-7q32.2 | 126.07-129.78 | 3.70 | 48 | CALU, TNPO3, UBE2H, ARF5, RBM28, IRF5, METTL2, CDC26 | | hsa-mir-(129-1, 182, 96, 183, 335) |
| 8q24.12-8q24.13 ◆ | 120.50-128.62 | 6.02 | 37 | DEPDC6, MRPL13, DERL1, ZHX1, TATDN1, RNF139, FBXO32 | | |
| 8q24.21 | 128.50-130.82 | 2.43 | 6 | MYC | Si22 | |
| 9q34.11-9q34.3 | 127.35-137.60 | 10.26 | 202 | ABL1, CIZ1, NUP188, SET, ENDOG, SURF1, SURF2, SURF4, CAMSAP1, UBADC1, SDCCAG3, EDF1, DPP7, ANAPC2, COBRA1 | Notch1, Ppp2r4, Gfi1b, Evi43 | hsa-mir-(199b, 219-2, 126) |
| 9q34.3 | 137.62-138.29 | 0.67 | 9 | MRPL41, ZMYND19, EHMT1 | | |
| 10p12.33-10p12.31 | 17.69-22.09 | 4.40 | 15 | DNAJC1 | | |
| 11p13 | 33.30-34.10 | 0.81 | 8 | CD59, FBXO3, M11S1, HIPK3 | Lmo2 | |
| 11p11.2 | 46.72-47.39 | 0.67 | 12 | ACP2, CKAP5, DDB2 | Sfpi1 | |
| 11q13.4-11q14.1 | 73.40-77.71 | 4.30 | 54 | SPCS2, RPS3 | | hsa-mir-326 |
| 11q14.1 | 77.01-82.80 | 5.79 | 20 | PCF11, HBXAP | | |
| 11q23.3 | 112.74-122.23 | 9.49 | 60 | UBE4A, ATP5L, RPS25, HMBS, CBL, DDX6, TRAPPC4, HYOU1, RNF26 | | |
| 12q24.33 | 131.00-131.07 | 0.07 | 2 | | | |
| 14q11.2 | 17.62-17.71 | 0.10 | 4 | | | |
| 15q24.2 | 73.45-73.72 | 0.27 | 4 | IMP3 | | |
| 16q24.2 | 86.43-87.13 | 0.70 | 6 | | | |
| 17p11.2 | 17.62-17.71 | 0.10 | 4 | RPL13, PAIP1 | | |
| 17q21.31-17q21.32 | 42.20 44.66 | 2.46 | 48 | COC27, KPNB1, CDK5, RAP3, NPEPP3, SP2, SCAP1 | Hoxb1 | has-mir-(152, 10a, 196a-1) |
| 17q23.2 | 53.94-54.69 | 0.75 | 11 | MTMR4, FLJ11029, RAD51C | | hsa-mir-301 |
| 17q23.3-17q24.3 | 59.31 65.64 | 6.33 | 52 | PRKAR1A, DDXS, SMURF2, P3MD12, KPNA2, WIPI49, PECAM1, PRKCA | | |
| 18q12.1-18q12.2 | 30.53-31.95 | 1.43 | 12 | ZNF271, P15RS, SLC39A6 | Evi135 | hsa-mir-187 |
| 18q21.33-18q23 | 58.17-78.00 | 17.82 | 64 | BCL2, FVT1, SERPINB7 | Evi36, Evi138 | |
| 19p13.3 | 0.24-2.19 | 1.95 | 77 | CDC34, POLRMT, WDR18, ATP5D, MUM1, NDUFS7, RPS15, UQCR, REXO1, CSNK1G2, MOBKL2A, MKNK2 | Tcfe2a, Evi103 | |
| 19q13.3-19q13.2 | 2.38 11.19 | 8.82 | 234 | INSR, TIMM13, MRPL54, EEF2, MAP2K2, HDGF2, TICAM1, RPL36, NDUFA11, CLPP, SH2D3A, NDUFA7, RPS28, RAB11B, EIF3S4, MRPL4, ICAM1, ICAM3, CDC37, APG4D, ILF3, QTRT1, SMARCA4 | Evi158 | hsa-mir-(7-3, 199a-1) |
| 19q13.11 | 37.57-38.16 | 0.59 | 9 | PDCD5, ANKRD27 | | |
| 19q13.12 | 41.33-41.90 | 0.57 | 11 | ZNF146 | | |
| 19q13.2 | 44.51-44.66 | 0.15 | 8 | ZFP36, RPS16, SUPT5H | Evi24 | |
| 19q13.31 | 49.11-49.85 | 0.75 | 47 | ZNF227 | | |
| 19q13.32-19q13.43 | 53.31-63.07 | 9.76 | 346 | FLT3LG, AKT1S1, PSCD2, RPL18, BAX, RUVBL2, SNRP70, RPL13A, RPS11, TBC1D17, NUP62, NDUFA3, PRPF31, RPS9, HSPBP1, RPL28, UBE2S, U2AF2 | | hsa-mir-(150, 99b, 125a, 372, 373) |
| 20q12-20q13.12 ◆ | 39.14-43.39 | 4.25 | 43 | TDE1, SFRS6, YWHAB, PPIA | | |
| 21q22.3 | 45.54-46.91 | 1.37 | 17 | MCM3AP, C21orf106, HRMT1L1 | | |

TABLE 2

High-Confidence MCRs in Multiple Myeloma: Loss and Deletion

| | | | | | | MCR recurrence | | | | | |
| | MCRs | | | | | Gains/losses | | Amps/dels | | | |
| Cytogenic band | Position (Mb) | Size (Mb) | Max/min | Known genes | % | Tumors | Cell lines | Tumors | Cell lines | Candidate genes | miRNA | Integration sites |
|---|---|---|---|---|---|---|---|---|---|---|---|---|
| 1p36.2♦ | 10.41-10.62 | 0.21 | −0.98 | 4 | 12 | 6 | 7 | 4 | 0 | DFFA | | |
| 1p35.3♦ | 30.86-31.04 | 0.18 | −0.98 | 4 | 14 | 7 | 8 | 5 | 1 | LAPTM5 | | |
| 1p32.3-1p.32.2♦ | 54.23-57.13 | 2.89 | −0.67 | 23 | 25 | 12 | 16 | 8 | 9 | SSBP3, USP24 | | |
| 1p13.3-1p12*,♦ | 111.49-118.21 | 6.73 | −1.00 | 71 | 41 | 15 | 30 | 13 | 21 | DENND2D, DDX20, ST7L, PPP2CZ, LRIG2, PTPN22, CD58, IGSF2 | | Rap1a, Nras |
| 3p21.31 | 46.68-47.03 | 0.16 | −1.61 | 5 | 11 | 1 | 11 | 1 | 3 | CCDC12, HYPB | | |
| 4q11-4q13.2 | 52.59-68.44 | 15.86 | −0.93 | 48 | 19 | 3 | 18 | 3 | 3 | CENPC1, BRDG1 | | Dkml9 |
| 4q13.3-4q21.1 | 71.10-76.94 | 5.84 | −0.81 | 51 | 19 | 3 | 18 | 3 | 3 | RASSF6, MOBKL1A | | Crtz1 |
| 4q22.1* | 88.47-89.09 | 0.62 | −1.16 | 10 | 17 | 2 | 17 | 2 | 4 | IBSP, SPARCL1 | | |
| 4q23 | 99.84-100.59 | 0.75 | −1.70 | 9 | 18 | 3 | 17 | 3 | 3 | TM4SF9, METAP1 | | |
| 6p25.3 | 0.30-0.36 | 0.06 | −1.12 | 2 | 4 | 4 | 1 | 4 | 0 | DUSP22 | | |
| 8p23.3-8p21.3 | 0.19-20.12 | 19.94 | −0.89 | 135 | 28 | 16 | 15 | 13 | 11 | NAT2, RP1L1, PINX1, TUSC3, DLC1, MTUS1 | hsa-mir-124a-1 | |
| 8p21.3-8p12 | 22.08-33.57 | 11.49 | −0.97 | 87 | 33 | 18 | 18 | 14 | 14 | TNFRSF10B, PPP2R2A, BNIP3L | hsa-mir-320 | |
| 10q25.1-10q25.2 | 111.64-112.35 | 0.71 | −0.90 | 6 | 18 | 4 | 16 | 1 | 4 | MXI1 | | |
| 10q26.2-10q26.3 | 128.90-135.24 | 6.34 | −1.27 | 40 | 18 | 4 | 16 | 2 | 6 | PTPRE, PPP2R2D, BNIP3, INPP5A | | Evi168 |
| 11p15.4 | 5.73-5.80 | 0.07 | −3.44 | 6 | 15 | 4 | 12 | 2 | 2 | OR52N4, OR52N5, OR52N1, OR52N2 | | |
| 11q11 | 55.10-55.18 | 0.08 | −3.86 | 2 | 7 | 4 | 4 | 2 | 0 | OR4C16, OR4C11, OR4P4, OR4S2 | | |
| 11q22.1-11q22.2 | 100.46-102.15 | 1.69 | −2.12 | 14 | 9 | 4 | 6 | 4 | 5 | PORIMIN, YAP1, MMP8 | | |
| 11q23.2-11q23.3 | 112.82-114.55 | 1.73 | −0.94 | 15 | 5 | 2 | 4 | 2 | 3 | IGSF4 | | |
| 11q24.2-11q24.3 | 125.67-125.28 | 2.61 | −2.10 | 12 | 8 | 1 | 8 | 1 | 4 | ST3GAL4, FL11, LOC367820 | | Fli1 \| Ets1 |
| 12q13.11-12q13.12 | 45.81-47.70 | 0.89 | −0.80 | 30 | 10 | 4 | 7 | 1 | 2 | ANP32D | | |
| 12q13.2 | 54.82-54.89 | 0.07 | −1.71 | 5 | 7 | 5 | 3 | 1 | 1 | SMARCC2 | | |
| 12q14.1-12q14.2 | 61.01-62.67 | 1.66 | −1.02 | 9 | 8 | 3 | 6 | 1 | 1 | PPM1H | hsa-let-7i | |
| 12q23.2-12q23.3 | 101.33-102.98 | 1.65 | −0.90 | 12 | 12 | 3 | 10 | 1 | 4 | STAB2 | | Evi12 |
| 13q34 | 112.24-113.01 | 0.77 | −1.01 | 12 | 49 | 32 | 22 | 28 | 16 | CUL4A | | |
| 14q12 | 29.29-31.66 | 1.23 | −0.80 | 11 | 32 | 9 | 26 | 7 | 8 | STRN3, HECTD1 | | |
| 14q32.13-14q32.2 | 93.92-95.63 | 1.71 | −0.96 | 22 | 33 | 13 | 23 | 9 | 11 | 8CL11B | | Evi151 |
| 15q15.1 | 39.46-39.58 | 0.12 | −1.41 | 5 | 8 | 1 | 8 | 1 | 1 | NUSAP1 | | |
| 16p13.3 | 2.10-2.24 | 0.13 | −2.07 | 10 | 14 | 7 | 8 | 1 | 2 | PKD1, TRAF7, E4F1 | | |
| 16q11.2-16q12.2♦ | 45.17-52.87 | 7.70 | −1.71 | 45 | 23 | 23 | 11 | 20 | 6 | DNAJA2, SIAH1, PAPD5, NKD1, CARD15, RBL2, FTS, CYLD | | |
| 16q13♦ | 56.23-56.57 | 0.14 | −1.13 | 9 | 29 | 20 | 12 | 14 | 7 | GPR56, KATNB1, KIFC3, CNGB1 | | |
| 16q24.1-16q24.2 | 83.46-85.89 | 2.44 | −1.29 | 20 | 31 | 19 | 15 | 13 | 8 | FOXC2, FOXL1 | | Evi96, Zdhhc7 |
| 16q24.3♦ | 88.23-88.63 | 0.39 | −1.29 | 19 | 31 | 19 | 15 | 9 | 8 | GAS8 | | |
| 17p13.2*,♦ | 3.31-4.79 | 1.49 | −1.31 | 43 | 23 | 5 | 20 | 2 | 14 | TAX1BP3, GSG2 | | |
| 17p13.1-17p12*,♦ | 6.45-13.92 | 7.47 | −1.03 | 125 | 30 | 6 | 27 | 2 | 19 | TP53, TNFSF12, TNFSF13 | hsa-mir-195 hsa-mir-324 | Trp53 |
| 19q13.33 | 53.58-55.63 | 0.10 | −1.14 | 5 | 12 | 1 | 12 | 1 | 2 | POLB1, SPIB | | |
| 20p12.1♦ | 13.08-17.41 | 4.33 | −0.87 | 21 | 15 | 10 | 7 | 6 | 3 | OTOR | | |
| 20q11.21 | 29.75-30.25 | 0.50 | −1.64 | 13 | 7 | 6 | 2 | 3 | 1 | FKHL18, DUSP15, HCK | | Bct2l, Evi47, Cri07 |
| 20q13.12♦ | 43.97-44.11 | 0.14 | −1.08 | 6 | 12 | 8 | 5 | 4 | 1 | PCIF1 | | |
| 21p11.2-21p11.1 | 9.93-10.17 | 0.24 | −1.11 | 3 | 6 | 1 | 6 | 1 | 1 | TPTE | | |
| 22q11.23 | 22.64-23.06 | 0.43 | −1.59 | 10 | 25 | 12 | 15 | 2 | 6 | DKFZP434P211 | | |

TABLE 3

| | | | | Subgroups | | Survival | | Event-free | |
|---|---|---|---|---|---|---|---|---|---|
| No. | Sex | Age | light chain | kA-kB | k1-k4 | (wks) | Death | survival (wks) | Relapse |
| 1 | F | 70 | κ | A | 1 | 53.33 | | 53.33 | |
| 2 | F | 63 | κ | A | 1 | 45.17 | | 45.17 | |
| 3 | F | 48 | κ | A | 1 | 44.97 | | 36.8 | Yes |
| 4 | F | 54 | κ | A | 1 | 45.43 | | 45.43 | |
| 5 | F | 60 | λ | A | 1 | 28.67 | Yes | 24.73 | Yes |
| 6 | F | 59 | κ | A | 1 | 40.57 | | 40.57 | |
| 7 | F | 56 | κ | A | 1 | 39.67 | | 39.67 | |
| 8 | M | 39 | κ | A | 1 | 53.8 | | 53.8 | |
| 9 | M | 59 | κ | A | 1 | 53.57 | | 53.57 | |
| 10 | M | 61 | λ | A | 1 | 51.57 | | 51.57 | |
| 11 | M | 62 | κ | A | 1 | 55.73 | | 55.73 | |
| 12 | M | 44 | κ | A | 1 | 56.33 | | 56.33 | |
| 13 | M | 55 | κ | A | 1 | 36.13 | Yes | 36.13 | Yes |
| 14 | M | 55 | κ | A | 1 | 46.37 | | 46.37 | |
| 15 | M | 53 | κ | A | 1 | 48.67 | | 48.87 | |
| 16 | M | 58 | λ | A | 1 | 44.2 | | 44.2 | |
| 17 | M | 61 | κ | A | 1 | 43.8 | | 43.8 | |
| 18 | M | 50 | κ | A | 1 | 42.9 | | 21.67 | Yes |
| 19 | M | 43 | κ | A | 1 | 41.73 | | 41.73 | |
| 20 | M | 66 | κ | A | 1 | 30 | | 30 | |
| 21 | M | 67 | κ | A | 1 | NA | NA | NA | NA |
| 22 | F | 38 | λ | A | 2 | 19 | Yes | 19 | Yes |
| 23 | F | 46 | κ | A | 2 | 54.57 | | 54.57 | |
| 24 | F | 51 | λ | A | 2 | 46.67 | | 46.67 | |
| 25 | F | 67 | λ | A | 2 | 33.93 | | 33.93 | |
| 26 | F | 62 | κ | A | 2 | 30.5 | | 1.67 | Yes |
| 27 | M | 70 | κ | A | 2 | 58.23 | | 58.23 | |
| 28 | M | 67 | κ | A | 2 | 42.67 | Yes | 42.67 | Yes |
| 29 | M | 57 | κ | A | 2 | 65.2 | | 33.13 | Yes |
| 30 | M | 56 | λ | A | 2 | 30.3 | Yes | 30.3 | Yes |
| 31 | M | 47 | κ | A | 2 | 43.07 | | 43.07 | |
| 32 | M | 55 | λ | A | 2 | 52.2 | | 52.2 | |
| 33 | M | 68 | κ | A | 2 | 50.63 | | 48.8 | Yes |
| 34 | M | 58 | κ | A | 2 | 14.77 | Yes | 14.77 | Yes |
| 35 | M | 63 | κ | A | 2 | 49 | | 6.43 | Yes |
| 36 | M | 55 | κ | A | 2 | 44.2 | | 44.2 | |
| 37 | M | 57 | λ | A | 2 | 41.27 | | 33.47 | Yes |
| 38 | M | 60 | κ | A | 4 | 19.63 | Yes | 19.63 | Yes |
| 39 | F | 54 | κ | B | 3 | 53.3 | | 53.3 | |
| 40 | F | 70 | λ | B | 3 | NA | NA | NA | NA |
| 41 | F | 64 | κ | B | 3 | 15.63 | Yes | 9.4 | Yes |
| 42 | M | 54 | κ | B | 3 | 54 | | 54 | |
| 43 | M | 57 | λ | B | 3 | NA | NA | NA | NA |
| 44 | M | 53 | λ | B | 3 | 20.13 | Yes | 20.13 | Yes |
| 45 | M | 53 | κ | B | 3 | 37.83 | Yes | 37.83 | Yes |
| 46 | M | 65 | λ | B | 3 | 49.23 | | 10.8 | Yes |
| 47 | M | 61 | κ | B | 3 | 42.47 | | 42.47 | |
| 48 | M | 42 | κ | B | 3 | 40.83 | | 10.3 | Yes |
| 49 | M | 63 | λ | B | 3 | 5.37 | Yes | 5.37 | Yes |
| 50 | M | 60 | κ | B | 3 | 29.57 | | 29.57 | |
| 51 | M | 38 | κ | B | 3 | 31.73 | | 31.73 | |
| 52 | F | 65 | λ | B | 4 | 47.8 | | 47.8 | |
| 53 | F | 64 | κ | B | 4 | 31.9 | Yes | 31.9 | Yes |
| 54 | F | 36 | κ | B | 4 | 44.8 | | 44.8 | |
| 55 | F | 60 | λ | B | 4 | 30.57 | Yes | 12.83 | Yes |
| 56 | F | 55 | λ | B | 4 | 17.27 | Yes | 16.73 | Yes |
| 57 | F | 65 | κ | B | 4 | 39.43 | | 39.43 | |
| 58 | F | 65 | λ | B | 4 | 31.73 | | 31.73 | |
| 59 | F | 66 | λ | B | 4 | 30.97 | | 30.97 | |
| 60 | M | 67 | κ | B | 4 | 53.1 | | 53.1 | |
| 61 | M | 50 | λ | B | 4 | 50.97 | | 50.97 | |
| 62 | M | 53 | λ | B | 4 | 47.43 | Yes | 47.43 | Yes |
| 63 | M | 49 | λ | B | 4 | 52.4 | | 32.63 | Yes |
| 64 | M | 56 | κ | B | 4 | 47.27 | | 47.27 | |
| 65 | M | 49 | κ | B | 4 | 45.43 | | 45.43 | |
| 66 | M | 60 | κ | B | 4 | 10.73 | Yes | 10.73 | Yes |
| 67 | M | 58 | κ | B | 4 | 42.47 | | 42.47 | |

TABLE 4

Probes significantly overexpressed in k2 versus k1 in Chromosome 1q21-q23

| Probes | Start | End | Gene | Accession |
|---|---|---|---|---|
| 203035_s_at | 143,065,076 | 143,075,590 | PIAS3 | NM_006099 |
| 225463_x_at | 143,253,641 | 143,254,269 | GPR89 | BF941168 |
| 220642_x_at | 144,625,363 | 144,690,385 | GPR89 | NM_016334 |
| 223531_x_at | 144,625,363 | 144,690,385 | GPR89 | AF151035 |
| 243367_at | 145,732,892 | 145,733,306 | AI018561 | AI018561 |
| 209268_at | 146,852,936 | 146,930,578 | VPS45A | AF165513 |
| 221189_s_at | 147,272,993 | 147,292,829 | FLJ12528 | NM_025150 |
| 218222_x_at | 147,595,259 | 147,662,259 | ARNT | NM_001668 |
| 1553072_at | 147,822,165 | 147,833,135 | BNIPL | NM_138279 |
| 236534_at | 147,832,700 | 147,833,135 | BNIPL | W69365 |
| 221222_s_at | 147,833,332 | 147,836,969 | FLJ20519 | NM_017660 |
| 239023_at | 147,843,307 | 147,843,784 | AF1Q | AI275994 |
| 223762_at | 147,955,536 | 147,961,499 | AF177173 | AF177173 |
| 200660_at | 148,818,055 | 148,822,584 | S100A11 | NM_005620 |
| 207710_at | 149,472,373 | 149,472,950 | SPRL1B | NM_014357 |
| 217728_at | 150,320,149 | 150,321,576 | S100A6 | NM_014624 |
| 203166_s_at | 150,329,171 | 150,331,355 | S100A4 | NM_002961 |
| 204268_at | 150,346,660 | 150,351,379 | S100A2 | NM_005978 |
| 202809_s_at | 150,513,640 | 150,559,628 | FLJ21919 | NM_023015 |
| 217778_at | 150,744,662 | 150,753,261 | SLC39A1 | NM_014437 |
| 226455_at | 150,759,421 | 150,759,899 | CREB3L4 | AL563283 |
| 200048_s_at | 150,759,820 | 150,763,524 | JTB | NM_006694 |
| 214695_at | 151,056,672 | 151,057,051 | AW051361 | AW051361 |
| 217489_s_at | 151,190,742 | 151,253,261 | IL6R | S72848 |
| 244040_at | 151,488,252 | 151,488,532 | N47474 | N47474 |
| 205903_s_at | 151,492,990 | 151,655,827 | KCNN3 | NM_002249 |
| 205902_at | 151,492,990 | 151,655,827 | KCNN3 | AJ251016 |
| 214853_s_at | 151,747,763 | 151,748,172 | SHC1 | AI091079 |
| 201469_s_at | 151,748,878 | 151,749,480 | SHC1 | AI809967 |
| 219373_at | 151,925,440 | 151,926,069 | DPM3 | NM_018973 |
| 224885_s_at | 151,958,287 | 151,958,441 | KRTCAP2 | BE260771 |
| 209093_s_at | 152,017,316 | 152,024,098 | GBA | K02920 |
| 203550_s_at | 152,030,070 | 152,038,347 | C1orf2 | NM_006589 |
| 201275_at | 152,091,823 | 152,103,529 | FDPS | NM_002004 |
| 224233_s_at | 152,393,080 | 152,397,831 | FLJ10504 | BC002535 |
| 218296_x_at | 152,393,080 | 152,397,831 | FLJ10504 | NM_018116 |
| 218291_at | 152,837,678 | 152,841,372 | MAPBPIP | NM_014017 |
| 223544_at | 153,065,812 | 153,075,272 | MGC13102 | BC005094 |
| 225401_at | 153,075,552 | 153,075,977 | MGC31963 | BF977145 |
| 242843_at | 153,428,600 | 153,428,875 | AA622130 | AA622130 |
| 229346_at | 153,455,303 | 153,455,947 | NES | AW028075 |
| 200896_x_at | 153,524,975 | 153,534,609 | HDGF | NM_004494 |
| 208938_at | 153,550,347 | 153,583,682 | PRCC | BC004913 |
| 224406_s_at | 154,296,240 | 154,335,383 | IRTA2 | AF343664 |
| 231647_s_at | 154,315,100 | 154,315,645 | IRTA2 | AW241983 |
| 205987_at | 155,072,877 | 155,076,480 | CD1C | NM_001765 |
| 208584_at | 157,072,458 | 157,126,528 | COPA | U24105 |
| 232219_x_at | 157,942,476 | 157,948,586 | USP21 | AL157417 |
| 232107_at | 158,150,885 | 158,152,022 | AK023394 | AK023394 |

TABLE 5

Probes signficantly downregulated in k2 versus k1 in chromosome 13q14

| Probes | Start | End | Gene | Accession |
|---|---|---|---|---|
| 225887_at | 38,482,304 | 38,483,327 | C13orf23 | AL522406 |
| 202724_s_at | 40,027,817 | 40,138,734 | FOXO1A | NM_002015 |
| 212603_at | 40,201,433 | 40,243,293 | MRPS31 | NM_005830 |
| 203599_s_at | 40,533,697 | 40,556,139 | WBP4 | NM_007187 |
| 203156_at | 41,744,289 | 41,795,402 | AKAP11 | NM_016248 |
| 227609_at | 42,360,118 | 42,360,638 | EPSTI1 | AA633203 |
| 227808_at | 42,580,557 | 42,581,038 | DNAJD1 | AI091398 |
| 223606_x_at | 44,461,687 | 44,500,405 | KIAA1704 | AF245045 |
| 229891_x_at | 44,505,285 | 44,505,738 | KIAA1704 | AI630799 |
| 209595_at | 44,592,672 | 44,756,237 | GTF2F2 | BC001771 |
| 226782_at | 44,865,456 | 44,865,993 | SLC25A30 | BF001919 |
| 1569124_at | 45,699,648 | 45,700,325 | BC030276 | BC030276 |
| 226795_at | 46,224,528 | 46,225,126 | AW007739 | AW007739 |
| 219347_at | 47,509,704 | 47,519,283 | NUDT15 | NM_018283 |
| 218589_at | 47,883,276 | 47,887,947 | P2RY5 | NM_005767 |
| 204759_at | 47,961,102 | 48,005,317 | CHC1L | NM_001268 |
| 1552691_at | 49,100,436 | 49,106,009 | ARL11 | NM_138450 |
| 230192_at | 49,490,084 | 49,490,604 | RFP2 | AI472310 |

SEQUENCE LISTING (713 sequences)

SEQ ID NO: 1 - DNA, 2187 bp, Homo sapiens
cagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatgtgtgtgatgagcataaggaattcaaggatgtcaaactcttctaccgctttagaaaggatgacggcaccttcccattggataatgaagtgaaggcctttatgagaggacagaggctatatgaaaagctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatgtgtccagcaagcacccatttgtggacagcaatcttctctaccagttcagaatgaacttccggcggaggcgaagactgatggagctgctcaatgaaaagtccccctcctcccaggaaactcatgacagtcccttctgcctggggaagcagagccatgacaatcggaaatctaccagctttatgtcagtgagccccagcaaggagatcaagatcgtgtctgcagtgaggagaagcagcatgagcagctgtggcagcagcggctacttcagcagcagccccaccctcagcagcagcccccctgtgctctgcaaccccaagtccgtgctgaagagacctgtcacctctgaggaactccttactcccggggctccgtatgcaaggaagacattcacgattgttggtgacgcggttggctggggttttgtggtgcgaggaagtaagccatgccacatccaggctgtagaccccagtggccctgcagccgcagcaggaatgaaggtctgtcagtttgtcgtctctgtcaacgggctcaatgtcctgcatgtagactaccggaccgtgagcaatctgattctgacgggcccacggacgattgtcatggaagtcatggaggagttagagtgctgagctcctgggcctcccagccctccagtggcctgtgggtgagggaagccagaatgacacaaagcaatgcaaagacaagattgccatgcaaatggatggttttggacatacgagtcttctccgcacatacatgtctaaagttgagttttatacactgaatgtggaagaaccgggtatcatatcttttttaaaaaatgtcagtgtagaaaacatttgggaaaccattttcctacatgatagaactgccttactagatttctatttgtagctctcattcattgttttttatcttagtttgcagaaaggtgttgaaatgcttctctagcccaaacagcgacatgctaaagtccccttcttcagagtcaatagagtagttgttaaaggttttaaattgtactttctccaaaattagcatgcagctatttaatagggaatctagatttcaccaagattcaaatcaaagcaacatttaaaggaataagacctgttcactagcattttcaagggggttctaaagcattcaagtgcttaaaagccataaaaaatgacttcttaattcctgcctttagtgtcaacttttaagttaatacaggtttcaattgtggcattaggaaaaaaaaaaaaaccttgtgatgctatggttgggggtagttagggagagactacatgaaattgtgtgcccctattttctttctgatcctaaatcattttgttttataaatcagctatagcatctttctagaattaatcctgaatatgttgaatgttaaaatagagaagtttgtatatacacataattaaaaatcaacccttctggcaaaaaaaaaaaaaaaaaaaa

SEQ ID NO: 2 - DNA, 1479 bp, Homo sapiens
atgggctccgctccctgggccccggtcctgctgctggcgctcgggctgcgcggcctccaggcgggggcccgcagggccccggaccccggcttccaggagcgcttcttccagcagcgtctggaccacttcaacttcgagcgcttcggcaacaagaccttcccccagcgcttcctggtgtcggacaggttctgggtccggggcgaggggcccaccttcttctacactgggaacgagggcgacgtgtgggccttcgccaacaactcgggcttcgtcgcggagctggcggccgagcggggggctctactggtcttcgcggagcaccgctactacgggaagtcgctgccgttcggtgcgcagtccacgcagcgcgggcacacggagctgctgacggtggagcaggccctggccgacttcgcagagctgctccgcgcgctacgacgcgacctcggggcccaggatgcccccgccatcgccttcggtggaagttatggggggatgctcagtgcctacctgaggatgaagtatccccacctggtggcgggggcgctggcggccagcgcgcccgttctagctgtggcaggcctcggcgactccaaccagttcttccgggacgtcacggcggactttgagggccagagtcccaaatgcacccagggtgtgcgggaagcgttccgacagatcaaggacttgttcctacagggagcctacgacacggtccgctgggagttcggcacctgccagccgctgtcagacgagaaggacctgacccagctcttcatgttcgcccggaatgccttcaccgtgctggccatgatggactacccctaccccactgacttcctgggtcccctccctgccaaccccgtcaaggtgggctgtgatcggctgctgagtgaggcccagaggatcacggggctgcgagcactggcagggctggtctacaacgcctcgggctccgagcactgctacgacatctaccggctctaccacagctgtgctgaccccactggctgcggcaccggccccgacgccagggcctgggactaccaggcctgcaccgagatcaacctgaccttcgccagcaacaatgtgaccgatatgttcccggacctgcccttcactgacgagctccgccagcggtactgcctggacacctggggcgtgtggccccggcccgactggctgctgaccagcttctgggggggtgatctcagagccgccagcaacatcatcttctccaacgggaacctggacccctgggcagggggcgggattcggaggaacctgagtgcctcagtcatcgccgtcaccatccaggggggagcgcaccacctcgacctcagagcctcccacccagaagatcctgcttccgtggttgaggcgcggaagctggaggccaccatcatcggcgagtgggtaaaggcagccaggcgtgagcagcagccagctctgcgtggggggcccagactcagcctctga

SEQ ID NO: 3 - DNA, 1791 bp, Homo sapiens
cccagaaattctacccaagctccctcagcaccatgtaccgagcacttcggctcctcgcgcgctcgcgtcccctcgtgcgggctccagccgcagccttagcttcggctcccggcttgggtggcgcggccgtgccctcgttttggcctccgaacgcggctcgaatggcaagccaaaattccttccggatagaatatgatacctttggtgaactaaaggtgccaaatgataagtattatggcgcccagaccgtgagatctacgatgaactttaagattggaggtgtgacagaacgcatgccaaccccagttattaaagcttttggcatcttgaagcgagcggccgctgaagtaaaccaggattatggtcttgatccaaagattgctaatgcaataatgaaggcagcagatgaggtagctgaaggtaaattaaatgatcattttcctctcgtggtatggcagactggatcaggaactcagacaaatatgaatgtaaatgaagtcattagcaatagagcaattgaaatgttaggaggtgaacttggcagcaagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcaagattggacgtactcatactcaggatgctgttccacttactcttgggcaggaatttagtggttatgttcaacaagtaaaatatgcaatgacaagaataaaagctgccatgccaagaatctatgagctcgcagctggaggcactgctgttggtacaggtttaaatactagaattggctttgcagaaaaggttgctgcaaaagtggctgcacttacaggcttgccttttgtcactgctccgaataaatttgaagctctggctgctcatgacgctctggttgagctcagtggagccatgaacactactgcctgcagtctgatgaagatagcaaatgatattcgatttttgggttctggtcctcggtcaggtctgggagaattgatcttgcctgaaaatgaaccaggaagcagtatcatgccaggcaaggtgaaccctactcagtgtgaagcaatgaccatggttgcagcccaagtcatggggaaccatgttgctgtcactgtcggaggcagcaatggacattttgagttgaatgttttcaagccaatgatgattaaaaatgtgttacactcagccaggctgctgggggatgcttcagtttcctttacagaaaactgcgtggtgggaatccaggccaatacagaaaggatcaacaagctgatgaatgagtctctaatgttggtgacagctctcaatcctcatatagggtatgacaaggcagcaaagattgctaagacagcacacaaaaatggatcaaccttaaaggaaactgctatcgaacttggctatctcacagcagagcagtttgacgaatgggtaaaacctaaggacatgctgggtccaaagtgatttacataaatttataatgaaaataaacatgtataaaatttaaaaaaacagactcccatttcttaaaaacggataagtttgaaaggaaactgctattgaacttaagcatctctagcagagcaatttgatcagtatataaaaccctaggatgtgctaggtctaagatggattaaacaagtataaaataaaatacatttataaaataaaaaggaaaacagacttaaaa

SEQ ID NO: 4 - DNA, 615 bp, Homo sapiens
gcacttgcaagctgcccgcaatacgtcatggcgaccaaacgccttttcggggctacccggacgtgggccggctggggggcctgggagctcctaaaccccgccacttccggaagactcctggcccgggattatgccaagaaaccagttatgaagggggccaaatcgggaaaaggtgcagtgaccagcgaggccctcaaggaccccgacgtatgcacagatcctgtccagctcaccacatatgccatgggcgtcaacatctacaaggaagggcaggatgtacccctgaaaccggatgctgagtaccctgaatggctgttcgagatgaacttgggtcccccaaagaccctggaggagctggaccccgagagccgggagtactggcggcggctgcggaaacagaacatctggcgccacaaccggctgagcaagaacaagaggttgtagcatggagggcccggcatcgctgacccccacgccgagggcttgccgttttcccggaggacgtggacttttgtgagacaagaggcggctccccagcctgggtttccatgtgaccccacagtggggctggaccaggccctggaggccaataaagagctttctgggtaaaaaaaa

SEQ ID NO: 5 - DNA, 6095 bp, Homo sapiens
gcgccgtgcggcccgtgcgactcgccggacctcgcgggcgtccctgtacggagccctcggccggtcctagcagggattgtccccatttccagctccggagcgggcggctgcgccccgctcgtcgaggagctgcgctcacctcaggggcgggcccccgcctgcgttcgcggcgccagcagaagactgatttttggaaatatgtatttgggagacagtcacgtcctattgaataccttgtgctggtgctgccatcgaaaaatctggttacactctggggaggactgctaccactgcagaactgaaccacttcggccgtgagatgagtgtccggcctgagcaggcacaccatgaatagatacacaacaatcaggcagctcggggatggaacctacggttccgtcctgctgggaagaagcattgagtctggggagctgatcgctattaaaaaaatgaaaagaaaattttattcctgggaggaatgcatgaaccttcgggaggttaagtctttaaagaagctcaaccatgccaatgtagtcaaattaaaagaagttatcagggaaaatgatcatctttattttatcttcgagtacatgaaggaaaatctttaccagctcattaaagagagaaataagttgtttcctgagtctgctataaggaatatcatgtatcagatattacaaggactcgcatttattcacaaacacggcttctttcatcgagacttaaagcctgagaacctcctctgcatgggaccagaacttgtgaaaattgcagactttggtttggcccgagaaatacgatcaaaacctccatatacagattatgtatctaccagatggtacagggctccagaagtactcctgaggtctaccaactacagctcccccattgacgtctgggcggtgggctgcatcatggcagaagtttacaccctcaggccactcttccctggagccagtgaaattgacacaatattcaaaatttgccaagtgctggggacaccaaaaaagactgactggcctgaaggctatcaactttcaagtgcaatgaacttccgttggccacagtgtgtacccaataacttaaagaccttgattcccaatgctagcagtgaagcagtccagctcctgagagacatgcttcagtgggatcccaagaaacgaccaacagctagtcaggcacttcgatatccttacttccaagttggacacccactaggcagcaccacacaaaaccttcaggattcagaaaaaccacagaaaggcatcctggaaaaggcaggcccacctccttatattaagccagtcccacctgcccagccaccagccaagccacacacacgaatttcttcacgacagcatcaagccagccagccccctctgcatctcacgtacccctacaaagcagaggtctccaggacagatcacccaagccatctccaggaggacaagccaagcccgttgcttttcccatccctccacaacaagcatccacagtcgaaaatcacagctggcctggagcacaaaaatggtgagataaagccaaagagtaggagaaggtggggtcttatttccaggtcaacaaaggattcagatgattgggctgacttggatgacttggatttcagtccatccctcagcaggattgacctgaaaaacaagaaaagacagagtgatgacactctctgcaggtttgagagtgttttggacctgaagccctctgagcctgtgggcacaggaaacagtgcccccacccagacgtcatatcagcggcgagacacgcccaccctgagatctgcagccaagcagcactatttgaagcactctcgatacttgcctgggatcagtataagaaatggcatactctcgaatccaggcaaggaatttattccacctaatccatggtctagttctggcttgtctggaaaatcttcagggacaatgtcagtaatcagcaaagtaaattcagttggttccagctctacaagttctagtggactgactggaaactatgtcccttcctttctgaaaaaagaaatcggttctgctatgcagagggtacacctagcacctattccagacccttcccctggttattcctccctgaaggccatgagacctcatcctgggcgaccattcttccacacccagcctagaagcactcctgggttgataccacggcctccagccgcccagccagtgcatggccggacagactgggcttccaagtacgcatctcggcgatgactgtctgccttggtgatgaatctcttcctagggagaagcaggatactttccctcagctgactggtgttctacctgcaagatgtgcagagggcataaaagcaaatcaacactttatagttattcttctgaactaagacatgtcaatattcttttttaaagtttttttttaaaatattgatttgaatgcagtaggcttttttgtataaaattattttattctaaaactgggtcccattattttcttaaacaacagcattttgtatatatggattatgttttagcattttatacagtcaactttgtaatgaactttttaaaaattaattgattttcctttggggttccagataatattttctacagattttgaaaaatgtaataatattaatgcagtattgcaacaggggtgcaatttaaggctatgtgatagagggttatttactcagtgtgtgcagatatttatgaagtggtgaaatttcaagtgtggctcactaggtacttcaggccttcttggactgttgttagaaaagtgatcctctgcttttcttagtaggtcattggtttgatttttggataccactctgctgttctaaaaggactattatattatataattcactttgttttacttttgttccccagatgaaagaactctaagtaaatacattttaaaaaatttttctgacaccctttaatgtggttgcagatctcagatgaaaccaagcttaattatactatgccattatattctaatttattccatttttgaaatcaagttgtatgtgtaccaataaaagagatttctgcttcaaaaggctctcaacatgaaggttaacacagtcaatcaaacttacattcctgccaagatgcatggccaaaaaactaagtatcaaagcagcagaaggtttttgattatagtaactgagatggaattttgtgcctagctcagttctccagatctggctaggagcagtcaatgactaatgttctgtcctagccaaattctcaggacaatttggggagcagaaagagttatggcagaggttccactcatctacaaagtcacagtcacatgccacatttgatctcctaaccctggtgtagtttctttcaagagtgagaactttatttgttgggcagaggctgttccattgagaggaatgtttacagcagtttcaaaaatgacaaagtcagtttggagacagaaaaagacaaaaggtccagtctcatccatctctatatggtacatttgcctcacttatggttgccttaaaggcaagagggaaggtcaccatcagtgaacgcaatgcaatctcaacagtgtattgattcatattctcctagggctcaaactactctctattggttccaggataatgacaaattgaaccatatgtaagtaatcttttattttttattttttttttgagacagagtctcactctgtcacccaggctggagtgcagtggcgcgatcttagctctctgcaacctctgcctcccaggttcaagcctcctgagtaactgggactacaggcgcccgccaccacgcccagctaattttttgtatttttagtagagacggggtttcactgtgttagccaggacggcctcgatctcctgacctcgtgatccaccctcctccacctcccaaagtactgggattacaggcatgagccactgcacccagccaagtgatcatttttataggttaaaatgataggtgaaatgaatatagacactttcatatggttcaacctaatgacttggtaaattattgccttggtgtattaataatatgttgcattctgaacaaataaccatggcttccaaagggccctaacctaaaatcggagagtaatttatgctttggagaatttgactcaaatatatacttgaccaagcaccatgatccctaggggcatgagaaaagcacataatggatgtggatgtgataggtggtcttttcctgttaacaagctggcagcaaagcttcagaaaatatatatgcaagcacaacttgaagctgaattcatttctgtattatattctcaactcgttatctaaagcatcagaacatgtgttttcagagatgagtcctttactataaggttaatatttattttcattttctgtattatatatgaaaagtaaattaatgtgaaacctggcccagcttgctggaaagcaggttttaaattgtaaatattccttagaggagcaaatggattgtttaataccatagtctcagtaatctagcttatataaggtcattacattttttaactgaaaaacctagttacctgattattgcacattataaaattgtttttctaatactttatagggcccaacttcagaaaatacttcgcttttttctttttatgctttcgtttgtttaccagcaagcaacttccctggggaagccaaacacatattcataaaaaaaatcaagtagctgatgtgcagttgagaaaactagaggactgaaaaaacaaattttaactagcaaatgctgtgaattactcttcctccccttctctgaaatgggtaaaggacaaattgtgtaaaaaaacctatgcactatagaagggaatagtaaccatttcttttgtctctctgtttctgttctgactgagaacctgcagccatttcttgttacatgaaaacaaaatgctacttgttacctctattttttgttactatacaattatgaaatgtaatgtaagacaccaacagaaatgatatacctgtaactgtacctatcaggactatacctcatttacagtcagaaagcttactgggatgtcaggaaatgatacagggttggttctcatttcgtgccgaaatgagacagaaattcagtgacgaaggtgcgttgtaggggtattgatgtgccccaggtagtgccagcagagtagggaaaactgcatttgcataaaaactactcttgacatgattgttcattttacaaaaaaattccattaattaccaagccctcacccagcccatgtgtgataggatttatgtaggaagaaacttgattttcaaataattttttaaatgtatctcttgcctaaaggactatatacatctaataaagtaacactgtgtcatcttctggagttatcaaaaattgtatacaatcaagacaacacaagaattattttatttttgagtgcaaatacaggtactgttggagttgatgggcaccatgctttctcatgaagtagcatttccctaccatcaagccattgttttgtgccattcaggagaggaaaaaaaggaatttatgctgtacatttcagttcagtgtatgaccaaaagcaatatgtttataagaagatgtttgacatactaattattttatatcatttaaaccatactgtagcaacataatatatggagctaatttgtagaattatttttacgatttccaaacaaatgtactgtactgttatataatttattgtgaggaccttctcatggaagccattaggaaaacaaactagaggtaaatatcacattaatctgtattatcaatttctcatagacactgtgctaatgtgaattttaaatgacctgcatcaagtcttctgatctcagataactcagtacagatagcaattagtcagctgatttgattacaatggagtaaccgacaatatatttatttataaagcacatattcataataacgagaagaattcagaaaaccacttaagcaagacccttctgaaataaaaaatgttgctttttaaatagtttgtcctaaggtgtttaaaacatgtcaaccttatgtaaggaaaaatttcctggtccaaataaagttgaagtttaagaaaaattg

SEQ ID NO: 6 - DNA, 658 bp, Homo sapiens
gccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggccaagctggaccgggagacagaggagctgcaccatgacagggtgaccctggaggtgggcaaggtgatccagcaaggtcggcagagcaaggggcttacgcagaaggacctggccacgaaaatcaatgagaagccacaggtgatcgcggactatgagagcggacgggccatacccaataaccaggtgcttggcaaaatcgagcgggccattggcctcaagctccggggaaaggacattggaaagcccatcgagaaggggcctagggcgaaatgaacacaaagcctcgaaatcagtgcgctccagctgatctcgttccgccggttccccttggccgccagttccgttctcctcacgggccgaacggaacaaggggtccagcttgcgggggaccctccccagcccattcctgctgtcaaacaaacaaaaccttgcaaagcgaaaaaaaaaaaaaaaaaa

SEQ ID NO: 7 - DNA, 1464 bp, Homo sapiens
cgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaagcctttaaaaacggctgtcaggtttgatctcagtgtaacgacatggccagtgcctgttccccactcccttgccccaaaaggatctggaacac

SEQ ID NO: 8 - DNA, 4552 bp, Homo sapiens
agcgcccgccgcgtccggggccggctggtgcgcgagacgccgccgagagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctcagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtatttggctcccagaatctgaccacagtgaagctaaaaggggtgggtgacagcttcaagaagtatcctgactacgagtccaagggcatcaaggctcacttcaacctggatgagagtggcgtgctcagtctagacagggtggagtctgtatttgagacactggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattcccatgcagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttcctttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctac

SEQ ID NO: 9 - DNA, 1632 bp, Homo sapiens
ctccagtctgtctgtgctctcaaaaactttagtcgttataacaactgtgactgttgagaaatttcactgttttcctgcattcctggcgcgggactctagccagaggctccgaggactttgtagcgactgtcccaagcgtccagttcgatgcttctcagggcggcttgctttaagggcccacccctaaatttgggttgtaaaaatttttgaggcagaagctgaggaagattgtcattctgatactgtcagagcagatgatgatgaagaaaatgaaagtcctgctgaaacagatctgcaggcacaactccagatgttccgagctcagtggatgtttgaacttgctccaggtgtaagctctagcaatttagaaaatcgaccttgcagagcagcaagaggctctctccagaaaacatcggcagataccaaaggaaaacaagaacaggcaaaagaagaaaaggctcgagaactcttcctaaaagcagtagaagaagaacaaaatggagctctctatgaagccatcaagttttatcgtagggctatgcaacttgtacctgatatagagttcaagattacttatacccggtctccagatggtgatggcgttggaaacagctacattgaagataatgatgatgacagcaaaatggcagatctcttgtcctacttccagcagcaactcacatttcaggagtctgtgcttaaactgtgtcagcctgagcttgagagcagtcagattcacatatcagtgctgccaatggaggtcctgatgtacatcttccgatgggtggtgtctagtgacttggacctcagatcattggagcagttgtcgctggtgtgcagaggattctacatctgtgccagagaccctgaaatatggcgtctggcctgcttgaaagtttggggcagaagctgtattaaacttgttccgtacacgtcctggagagagatgtttttagaacggcctcgtgttcggtttgatggcgtgtatatcagtaaaaccacatatattcgtcaaggggaacagtctcttgatggtttctatagagcctggcaccaagtggaatattacaggtacataagattctttcctgatggccatgtgatgatgttgacaacccctgaagagcctcagtccattgttccacgtttaagaactaggaataccaggactgatgcaattctactgggtcactatcgcttgtcacaagacacagacaatcagaccaaagtatttgctgtaataactaagaaaaaagaagaaaaaccacttgactataaatacagatattttcgtcgtgtccctgtacaagaagcagatcagagttttcatgtggggctacagctatgttccagtggtcaccagaggttcaacaaactcatctggatacatcattcttgtcacattacttacaaatcaactggtgagactgcagtcagtgcttttgagattgacaagatgtacacccccttgttcttcgccagagtaaggagctacacagctttctcagaaaggcctctgtagagcctcaagtccagtcctctatcacttttgcatgaattaaagtatatagcgcaaaagaaaaaaaaaaaaaaaaaaaaaaaaaaaaaaaaaaaaaaaaaaaaaaaaaaaaa

SEQ ID NO: 10 - DNA, 1093 bp, Homo sapiens
ggctctcttcctgtctttgtggctccggaaaggcgtttgggatgccaacgatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaagtgctgcattagacgtggaactatctgatgattccttccctccagaagactttggcattgtgtctggaatgctcaatgtcaaatgggaccggattgcccctgctagcaatgtctcccacactgtggtcctgcgccctctcaaggctggttatttcaacttcacctcggcaacaattacttacctggcccaggaggatgggcccgttgtgattggctctaccagtgcacctggacagggaggaatcctggctcagcgggagtttgacaggcgattctcccctcattttctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccaattgc

SEQ ID NO: 11 - DNA, 843 bp, Homo sapiens
gcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggcagtgtagagctttatgctgaaaaggtggccactagaggtctgtgtgccattgcccaggcagagtctctgcgttacaaactcctaggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacaaaaaaaaaaaaaaa

SEQ ID NO: 12 - DNA, 621 bp, Homo sapiens
aaggcgcctgcgcagaccctgaaaagcggccagggtggcccctagctttccttttccggttgcggcgccgcgcggtgaggttgtctagtccacgctcggagccatgccgtccaagggcccgctgcagtctgtgcaggtcttcggacgcaagaagacagcgacagctgtggcgcactgcaaacgcggcaatggtctcatcaaggtgaacgggcggcccctggagatgattgagccgcgcacgctacagtacaagctgctggagccagttctgcttctcggcaaggagcgatttgctggtgtagacatccgtgtccgtgtaaagggtggtggtcacgtggcccagatttatgctatccgtcagtccatctccaaagccctggtggcctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatcctaccgataagcccatcgtgactcaaaactcacttgtataataaacagtttttgagggattttaaagtttcaaaaaaaaaaaaaaaa

SEQ ID NO: 13 - DNA, 5681 bp, Homo sapiens
cgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgca

SEQ ID NO: 14 - DNA, 3657 bp, Homo sapiens
taggaaggtatggcctcacaagtcttggtctacccaccatatgtttatcaaactcagtcaagtgccttttgtagtgtgaagaaactcaaagtagagccaagcagttgtgtattccaggaaagaaactatccacggacctatgtgaatggtagaaactttggaaattctcatcctcccactaagggtagtgcttttcagacaaagataccatttaatagacctcgaggacacaacttttcattgcagacaagtgctgttgttttgaaaaacactgcaggtgctacaaaggtcatagcagctcaggcacagcaagctcacgtgcaggcacctcagattggggtgtggcgaaacagattgcatttcctagaaggcccccagcgatgtggattgaagcgcaagagtgaggagttggataatcatagcagcgcaatgcagattgtcgatgaattgtccatacttcctgcaatgttgcaaaccaacatgggaaatccagtgacagttgtgacagctaccacaggatcaaaacagaattgtaccactggagaaggtgactatcagttagtacagcatgaagtcttatgctccatgaaaaatacttacgaagtccttgattttcttggtcgaggcacgtttggccaggtagttaaatgctggaaaagagggacaaatgaaattgtagcaatcaaaattttgaagaatcatccttcttatgcccgtcaaggtcaaatagaagtgagcatattagcaaggctcagtactgaaaatgctgatgaatataactttgtacgagcttatgaatgctttcagcaccgtaaccatacttgtttagtctttgagatgctggaacaaaacttgtatgactttctgaaacaaaataaatttagtcccctgccactaaaagtgattcggcccattcttcaacaagtggccactgcactgaaaaaattgaaaagtcttggtttaattcatgctgatctcaagccagagaatattatgttggtggatcctgttcggcagccttacagggttaaagtaatagactttgggtcggccagtcatgtatcaaagactgtttgttcaacatatctacaatctcggtactacagagctccagagattatattggggttgccattttgtgaagccatagacatgtggtcattgggatgtgtgattgcagaattatttcttggatggccgctctacccaggagccttggagtatgatcagattcgatacatttctcagactcaaggtttgccaggagaacagttgttaaatgtgggtactaaatccacaagatttttttgcaaagaaacagatatgtctcattctggttggagattaaagacattggaagagcatgaggcagagacaggaatgaagtctaaagaagccagaaaatacattttcaacagtctggatgatgtagcgcatgtgaacacagtgatggatttggaaggaagtgatcttttggctgagaaagctgatagaagagaatttgttagtctgttgaagaaaatgttgctgattgatgcagatttaagaattactccagctgagaccctgaaccatccttttgttaatatgaaacatcttctagatttccctcatagcaaccatgtaaagtcctgttttcatattatggatatttgtaagtcccacctaaattcatgtgacacaaataatcacaacaaaacttcacttttaagaccagttgcttcaagcagtactgctacactgactgcaaattttactaaaatcggaacattaagaagtcaggcattgaccacatctgctcattcagttgtgcaccatggaatacctctgcaggcaggaactgctcagtttggttgtggtgatgcttttcagcagacattgattatctgtcccccagctattcaaggtattcctgcaacacatggtaaacccaccagttattcaataagggtagataatacagttccacttgtaactcaggccccagctgtgcagccactacagatccgaccaggagttctttctcagacgtggtctggtagaacacagcagatgctggtgcctgcctggcaacaggtgacacccctggctcctgctactactacactaacttctgagagtgtggctggttcacacaggcttggagactgggggaagatgatttcatgcagcaatcattataactcagtgatgccgcagcctcttctgaccaatcagataactttatctgcccctcagccagttagtgtggggattgcacatgttgtctggcctcagcctgccactaccaagaaaaataaacagtgccagaacagaggtattttggtaaaactaatggaatgggagccaggaagagaggaaataaatgctttcagttggagtaattcattacagaataccaatatcccacattcagcatttatttctccaaagataattaatgggaaagatgtcgaggaagtaagttgtatagaaacacaggacaatcagaactcagaaggagaggcaagaaattgctgtgaaacatctatcagacaggactctgattcatcagtttcagacaaacagcggcaaaccatcattattgccgactccccgagtcctgcagtgagtgtcatcactatcagcagtgacactgatgaggaagagacttcccagagacattcactcagagaatgtaaaggtagtctagattgtgaagcttgccagagcactttgaatattgatcggatgtgttcattaagtagtcctgatagtactctgagtaccagctcctcagggcagtccagcccatccccctgcaagagaccgaatagtatgtcagatgaagagcaagaaagtagttgtgatacggtggatggctctccgacatctgactcttccgggcatgacagtccatttgcagagagcacttttgtggaggacactcatgaaaacacagaattggtatcctctgctgacacagaaaccaagccagctgtctgttctgttgtggtgccaccagtggaactagaaaatggcttaaatgccgatgagcatatggcaaacacagattctatatgccagccattaataaaaggacgatctgcccctggaagattaaaccagccttctgcagtgggtactcgtcagcaaaaattgacatcagcattccagcagcagcatttgaacttcagtcaggttcagcactttggatctgggcatcaagagtggaatggaaactttgggcacagaagacagcaagcttatattcctactagtgttaccagtaatccattcactctttctcatggaagtcccaatcacacagcagtgcatgcccacctggctggaaatacacacctcggaggacagcctactctacttccatacccatcatcagccaccctcagtagtgctgcaccagtggcccacctgttagcctctccgtgtacctcaagacctatgttacagcatccaacttataatatctcccatcccagtggcatagttcaccaagtcccagtgggcttaaatccccgtctgttaccatccccaaccattcatcagactcagtacaaaccaatcttcccaccacattcttacattgcagcatcacctgcatatactggatttccactgagtccaacaaaactcagccagtatccatatatgtga

SEQ ID NO: 15 - DNA, 4471 bp, Homo sapiens
ttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaataaatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaagcaaatataagctgggaaaaaagttttgatgaaattcttgaagttcatggtgatcagtgcaattgaccttctccctcactcctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagcattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagatttttaccatgtctctaagccaactttaattgcttaaaagacatttttatttagttgaaaaatctagttttttttgtaaactgtaccaaatctgtatatgttgtaataaaacttatgctagtttattggaagtgttcaagaaataaaaatcaacttgtgtactgataaaatactctagcctgggccagagaagataatgttctttaatgttgtcaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctcttggatggacccacgaacgctcttagctttctcagggggtcagcagagttattgaatcttaattttttttaatgtacaagttttgtataaataataaagaactccttattttgtattacatctaatgcttaagtgttgctcttggaaagctgatgatgtctcttgtagagatgactctgaaaaacattccaggaaaccatggcagcatggagagcctcttagtgattgtgtctgcattgttattgtggaagatttaccttttctgttgtacgtaaagcttaaattacttttgttgtgactttttagccagtgactttttctgagcttttcatggaagtggcagtgaaaaatatgttgagtgttcaaaaaagtgactgtaattaatatcttgctggattaatgttttgtacaattactaaattgtatacattttgttatagaatacttttttctagtttcagtaaataatgaaaaggaagttaatacca

SEQ ID NO: 16 - DNA, 3246 bp, Homo sapiens
  modified_base (2530)..(2530): a, c, g, t, unknown or other
agtgtggttttagtttttcctaagaagtggcgtggtttggggctttatatccgggaggagcatatgtacgcaaatcctggggcgtttgcaaacccggatccggggcgtctggccccatgcccggccgggcgtttgagggctactgccacgcagcgtttctggagcctgccggctggtgccctggtggcctttatctctgtccccctttgtcctctttatctcaggctctccaggaggccggggggcccactccgcctatcgctcccctcggctacgctgccactccaatgccccgcaggtcgcgagctgctgttctttcgaaggcgccggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacttatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtntaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaaccatgaaaaaa

SEQ ID NO: 17 - DNA, 1746 bp, Homo sapiens
gagcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 18 - DNA, 398 bp, Homo sapiens
ctctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaaaaaaaaaaaaaaa

SEQ ID NO: 19 - DNA, 1434 bp, Homo sapiens
gagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggaaagatgaatgggagggctgattttcgagagccgaatgcagaggttccaagaccaattccccacatagggcctgattacattccaacagaggaagaaaggagagtcttcgcagaatgcaatgatgaaagcttctggttcagatctgtgcctttggctgcaacaagtatgttgattactcaaggattaattagtaaaggaatactttcaagtcatcccaaatatggttccatccctaaacttatacttgcttgtatcatgggatactttgctggaaaactttcttatgtgaaaacttgccaagagaaattcaagaaacttgaaaattccccccttggagaagctttacgatcaggacaagcacgacgatcttcaccacctgggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaagtcaaagtaaacaagtatggagatacttgggatgagtgaaaaattacatcattggacatgaaggagtttcaacatccagcttcatctaggtggtcatgattacctgcatgctttgagctcagcagcagtcttcataaacacatttaaaacaagatcctgggtttttgtggtttgacttctatggtgttttaaaaaaacacagatttttagtgttaatattgtgtaaatgtactcaccttagggattcatttgaatgatggtattataccatgattgtatacagtttgtgaaattgttgcaagggcaaagataactcttaaaaaaccgtcgagattacaatgctctagaatcagcatataagaaaataaatgatatctgcatgttgaattggggtggatggggggagcaagcataatttttaagtgtgaagctttgcatcaagaaattattaaaaagctttttttctccagtattttctgtattatcttaatgtttatggcaaataaaatgtaaaggaacatgccaaaaaaaaaaaaaaaaaaaaaaaaaaaaaaaaaaaaaaaaaaaa

SEQ ID NO: 20 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 21 - DNA, 1573 bp, Homo sapiens
ggggcttttgctggtgtagctcgtccggttaccttcaggaagattggataaccaagaaatgactaatcaagagtctgccgtacatgtgaaaatgatgccagaattccagaaaagttcagttcgaatcaagaaccctacaagagtagaagaaattatctgtggtcttatcaaaggaggagctgccaaacttcagataataacggactttgatatgacactcagtagattttcatataaagggaaaagatgcccaacatgtcataatatcattgacaactgtaagctggttacagatgaatgtagaaaaaagttattgcaactaaaggaaaaatactacgctattgaagttgatcctgttcttactgtagaagagaagtacccttatatggtggaatggtatactaaatcacatggtttgcttgttcagcaagctttaccaaaagctaaacttaaagaaattgtggcagaatctgacgttatgctcaaagaaggatatgagaatttctttgataagctccaacaacatagcatccccgtgttcatattttcggctggaatcggcgatgtactagaggaagttattcgtcaagctggtgtttatcatcccaatgtcaaagttgtgtccaattttatggattttgatgaaactggggtgctcaaaggatttaaaggagaactaattcatgtatttaacaaacatgatggtgccttgaggaatacagaatatttcaatcaactaaaagacaatagtaacataattcttctgggagactcccaaggagacttaagaatggcagatggagtggccaatgttgagcacattctgaaaattggatatctaaatgatagagtggatgagcttttagaaaagtacatggactcttatgatattgttttagtacaagatgaatcattagaagtagccaactctattttacagaagattctataaacaagcattctccaagaagacctctctcctgtgggtgcaattgaactgttcatccgttcatcttgctgagagacttatttataatatatccttactctcgaagtgttccctttgtataactgaagtattttcagatatggtgaatgcattgactggaagctccttttctccacctctctcaacacactcctcaccgtatcttttaacccattttaaaaaaaaaaatcttaaagccaaaattagaaaaataactccctacttttccaaagtgaattttgtagtttaatgttatcatgcagcttttgaggagtcttttacactgggaaagtttgtagaaattttaaaataagttttatgaaatggtgaaataatatgcatgattttaagtattgccatttttgtaatttgggttattatgctgatggtatcaccatctcttgaaattgtgttaggtttggttattttgtctggggaaaaaatatttactggaaaagactagcagttagtgttggaaaaacctggtggtgtttacaatgttgctaatcattacaaaacattctatattgaagcactgataataaatatgaaatccaaaaaaaaaaaaaaaaaaaaaaaaaaaaa

SEQ ID NO: 22 - DNA, 995 bp, Homo sapiens
ttgctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagaacatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaaa

SEQ ID NO: 23 - DNA, 2986 bp, Homo sapiens
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggcccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagggtcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 24 - DNA, 515 bp, Homo sapiens
ctgcgcaggcgcggaccaaagcgatctcttctgaggatccggcaagatggcagaagtagagcagaagaagaagcggaccttccgcaagttcacctaccgcggcgtggacctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaagcccgagatgatcggccactacctgggcgagttctccatcacctacaagcccgtaaagcatggccggcccggcatcggggccacccactcctcccgcttcatccctctcaagtaatggctcagctaataaaggcgcacatgactcc

SEQ ID NO: 25 - DNA, 3738 bp, Homo sapiens
ctggcgcgcgcgcgcgccattgtgtggctggactcggccgcccctgtggtgtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccccaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgttttttttttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgaggaaaaaaaaaaaaaaaa

SEQ ID NO: 26 - DNA, 1967 bp, Homo sapiens
gtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagctcttgtgtaaggactgactacctggactgatcgcctgacagatcccacctgcctgtccactgcccatgactgagcccagccccagcccggggtccattgcccacattctctgtctccttctcgtcggtctaccccactacctccagggttttgctttgtccttttgtgaccgttagtctctaagctttaccaggagcagcctgggttcagccagtcagtgactggtgggtttgaatctgcacttatccccaccacctggggacccccttgttgtgtccaggactccccctgtgtcagtgctctgctctcaccctgcccaagactcacctcccttcccctctgcaggccgacggcaggaggacagtcgggtgatggtgtattctgccctgcgcatcccacccgaggactgagggaacctaggggggacccctgggcctggggtgccctcctgatgtcctcgccctgtatttctccatctccagttctggacagtgcaggttgccaagaaaagggacctagtttagccattgccctggagatgaaattaatggaggctcaaggatagatgagctctgagtttctcagtactccctcaagactggacatcttggtctttttctcaggcctgagggggaaccatttttggtgtgataaataccctaaactgcctttttttcttttttgaggtggggggagggaggaggtatattggaactcttctaacctccttgggctatattttctctcctcgagttgctcctcatggctgggctcatttcggtccctttctccttggtcccagaccttgggggaaaggaaggaagtgcatgtttgggaactggcattactggaactaatggttttaacctccttaaccaccagcatccctcctctccccaaggtgaagtggagggtgctgtggtgagctggccactccagagctgcagtgccactggaggagtcagactaccatgacatcgtagggaaggaggggagatttttttgtagtttttaattggggtgtgggaggggcggggaggttttctataaactgtatcattttctgctgagggtggagtgtcccatccttttaatcaaggtgattgtgattttgactaataaaaaagaatttgtaaaaaa

SEQ ID NO: 27 - DNA, 1803 bp, Homo sapiens
agtgttttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataaaaaaaaaaaaaaaaaaaaaaa

SEQ ID NO: 28 - DNA, 1040 bp, Homo sapiens
cagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtccccgccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcagagccagccgccaaggttgacctcagcttcggagccacctctggatgaactgcccccagcccccgccccattaaagacccggaagcctgaaaaaaaaaaaaaaaaaaaaaaaaaaaaaaaaaaaaaaaaaaaaa

SEQ ID NO: 29 - DNA, 1549 bp, Homo sapiens
ggcaagatggcggcgcccatggaggtggccgtgtgtacggactcggcggccccgatgtggagctgcatcgtgtgggaacttcactcgggcgccaacctgctcacctaccgcggcggccaggcgggaccccgcggcctggcgctgctcaatggcgagtatctgctggcggcgcagctgggcaagaattacatcagcgcctgggagctccagcggaaggaccagctccagcagaagatcatgtgccccgggcctgtcacctgtctgactgcatcacccaatggtctctacgtcctggcaggagttgcagaaagcatccacctgtgggaggtctccaccgggaaccttctggtcatcctgagtcgacactaccaggacgtctcctgccttcagttcacaggggacagcagccacttcatctcagggggcaaggactgcctggtgctggtttggagcctctgcagcgtgctgcaggccgacccctccaggattccggcgcccaggcacgtctggtctcaccacacgctccccatcacggacctgcactgcggctttgggggccccctggcccgggtggccacctcctcactggaccagacggtgaagctatgggaggtctcctcgggggagctgctgctctccgtcctctttgacgtgtccatcatggcagtgaccatggacctggctgagcaccatatgttctgcgggggcagtgagggctccatcttccaggtcgacctcttcacctggcccggacagagggagaggagcttccacccagagcaggacgccgggaaggtcttcaaagggcacaggaaccaggtgacttgcctgtcagtgtccactgacggcagcgtgctgctctcaggctcccacgacgagaccgtgcgcctctgggacgtgcagagcaagcagtgcatccggacggtggccctcaaaggcccagtcaccaatgccgccatcctgctggcgcccgtcagcatgctgagctcagacttcaggcccagcctgccgctgccccacttcaacaagcacctgctgggcgccgagcacggggacgagccgcgccacgggggcctcactctgcgcctgggcctccaccagcagggctcggagcccagctacctggaccgcacggagcagctgcaggccgtcctgtgcagcaccatggagaagagcgtgctcggcggccaggaccagctgcgcgtccgtgtgacggagctggaggacgaggtgcgcaacctgcgcaagatcaatcgggacctgttcgacttctccacgcgcttcatcacgcggccggccaagtgaggcccggagaccccggcccgaggcgcccaggcctgagccccatgcctcccagcaaccagggcccgcgggtgtggcccccaccagcccaggcctggactctcctcagttctgtgtcgtgttcgggtttttcctctgtgactgggccgtcttggtgtctcgtggcacgcgtcacagtggtgctagtctgtttttaacaaaagaggatgaaaagcctaaaaaaaaaaaaaaaaaaaaaaaaaaaaaa

SEQ ID NO: 30 - DNA, 6089 bp, Homo sapiens
aaaagtgaatacatgattttatttaactcattaataaggaaattggtaaggtgttaaaaccaattcaaaggacaatccaaagaacagatcaggaatactaaaataaatatgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctctgccttttcaccgtcctcccacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctccccgtaataggcggtggagttgctctgtgaggatgttcatggtagacactaagagggctgggtgggagatgcttggctctgtggcatctgttcagcgaggcttttcctatattgcatggagttagtcattgtgattgtagctttatttcataatatattaagacttgcactgctatttactagcagtgagaagaaacctcaggaaaggatatgaaaaagcaagtggccagtgtctgggatactgggccttggtaaagcagaggagggcacacccacagtcctcttattctctgttttactgcttgttttgaggttctggggtctggcaaagaggatgcagtttgacacctgcagccctttctcaatcccactaatgtcttactaatgtggaacagtccatattagctccagagagtgtcaaacccagagaaatgtgtgcaaaaatgatactcttttctgcattagccccaccattgtgttcaccaatgcttggaacactgcctgaaggcactcattttttaatttttattttatttttaattttttatatctttatgagacgatctcactctgtcaccaggttggagtacagtggtacaatcacaactcaccgtagcctcaaactcctgggctcaagtgattctcccacctcaggcacccaaatagctggaactacaggcatataccgccacacccagctaattttattttttgaaaagacaaggttccctatgttgcccagctggtcttaaactcctgggctccagcaattatcccagcttgggctccaaaagtgctgggattacaggcatgagtcaccatgcctggcctcattttttaaaacaaatgaataaatggacaaatgagtaaatgagaaagtctcacaccatgaaagatgctagtccaatgagctgaatacagaggtaatataaatgtcttccagctgttgcttttctgttctcaagctgcccctcctggggtaggagcataatctacatcactgggcagtcacaggacactctatagcaaggttgtagcgtcctctccagtggggggagaaaaggaactgtgcctaccaaaggtactctcttgtcagcaatttccatttctatactttatgggacactagaaactaaaagcaacaaataatctgatataagtccttgtatagtcatccttcaattcagtagcaatattttctggtcactactaacctgtattgtattaaaatgagactattggaaggaaatggtgctaaaactaataacatctcttaccaacctttacccaactcctgggttggcaaacagctgaccaaactgccatcacctcccacttggaagtgtatggccgacagcatgaaatagctgagcccagatgttccttctgcatcctccgaatcccagggctgggtgtaggtagccgttggaggccatcgctacagggcacctatctgttatcgctgctgtcctcccaacagctgtctccagttctagttccttggttttcaggcacagtgggggatgttctgcacccagtggacttcaaaagagttttgaagacttaattttttgtaaaacaagtacttgagattttggtttatccataatagaatgtatttcattagattctctgattctatataagaatgtgaaaagattgatatattgttgttagaaataatgttatttctttccaattttttttttttttttttttgagatggagtctcgctctgtcacccaggctggagtgcagtggtgtgatctcggctcactgcagcctctaactcccaggttcaagctattctcctgcctcagcctcccaagtagctggattacaggcatacaccaccacgcctggctatgttttgtatttttcgtagagatagggtttcaccatgttggccaggctggtctcaaactcctgacctcaagtgatccacccacttcagcttcccaaagcactgggattacaggtgtgagccactgtgcccggcaaatttttttacctttacagaaggttttgcttatttaattgtgagctcatttttctttgttacttttgtccccccagatttgggggacaaaataaaattaatcttttaaaatgtgtcagccatatgtatggggcttccatttggggtgatgagaaagttctggaactagatagtggtcatggttatacaacatcataaatgcaattactgccactgaattgtatgttttaaagtggttaaaatgttaagttttatgttttattacaatttttaaatgtgtcaaccaactttatagtacataaattatatctcagtaaagctgttaaataaataaatatagtaaaaattttagaactaaaaaaaaaaaaaaaaaaaa

SEQ ID NO: 31 - DNA, 1313 bp, Homo sapiens
gtcaagatggcgggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacacttggctgacctggcattgggagagggagggaggaaggaagggagggaggggctggaagatactgaaggattcctttttgaaaggtttttttttattgtaactt

SEQ ID NO: 32 - DNA, 749 bp, Homo sapiens
atggcggctaacgctactaccaacccgtcgcagctgctgccgttagagcttgtggacaaatgtataggatcaagaattcacatcgtgatgaagagtgataaggaaattgttggtactcttctaggatttgatgactttgtcaatatggtactggaagatgtcactgagtttgaaatcacaccagaaggaagaaggattactaaattagatcagattttgctaaatggaaataatataacaatgctggttcctggaggagaaggacctgaagtgtgaatgagtttccttgacttacactagattttgttttggcttataatgacaagaaaatggaattttttttcccactttctaatgtttaaatcccataaagctaagtttcccgttaaagggaagtgctttgaagatgtgtacccatttttgtaagttaatcatgattatcctggaaaaagaagaaaagaacttcttcttttgcagatgaaaataaaggtgtttttggttaactgtcattttgtttattctactgcagtagccagtggaacaaagtttgtagttattttgccacttacttttctgtcattatatgcttatttgttttgtcatttacgtgaccatttgattctcaaacaaaagttgttccaaacaaaatgatgaactttgatttgaacaggtgcatttaaacaaccggaaatgatcacttagaaaattcaattaaaatgctgttgttttgtaaaaaaaaaaaaaaaaaa

SEQ ID NO: 33 - DNA, 3889 bp, Homo sapiens
gagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcaccagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgtttttttttttttttttgtactgtgtcctcaaatttaatggattaatgtgtcttgtatatataaaaagaaaacctctaccttcaaaaaaaaaaaaaaaaaa

SEQ ID NO: 34 - DNA, 2341 bp, Homo sapiens
cccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccatcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaagaaaaaaaaaaaaaaaaaaaaaaaaaaaaaaaaaaaaa

SEQ ID NO: 35 - DNA, 1629 bp, Homo sapiens
tctttggtgctgggaggcgggcgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggaatatatatgtcccagatgtgaatcaggctttattgaagaagtgacagatgattccagttttttaggtggtggcggcagtcggatagacaataccacaacaacacattttgcagagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtaaaaa

SEQ ID NO: 36 - DNA, 4501 bp, Homo sapiens
gatcgccgcgcgagggtggtgggcatcgaggtcccagcagcggacgagggaggtgccgccgtcgcccaggatgggctgggaatgaagcgatgtagccttttaagagatttgctctgacccatctgaagtccatatggctctgtatgatgaagacctcctgaaaaatcctttctatctggctctgcaaaagtgccgccctgacttgtgcagcaaagtggcccaaatccatggcattgtcttagtaccctgcaaaggaagcctgtcgagcagcatccagtctacttgtcagtttgagtcctacattttgatacctgtggaagagcattttcagaccttaaatggaaaggatgtctttattcaagggaacaggattaaattaggagctggttttgcctgtcttctctcagtgcccattctctttgaagaaactttctacaatgaaaaagaagagagtttcagcatcctgtgtatagcccatcctttggaaaagagagagagttcagaagagcctttggcaccctcagatcccttttccctgaaaaccattgaagatgtgagagagttcttgggaagacactccgagcgatttgacaggaacatcgcctctttccatcgaacattccgagaatgcgagagaaagagcctccgtcaccacatagactcagcgaatgctctctacaccaaatgcctccagcagcttctgagggactctcacctgaaaatgctcgccaagcaggaggcccagatgaacctgatgaagcaggcagtggagatatacgtccatcatgaaatttacaacctgatctttaaatacgtggggaccatggaggcaagtgaggatgcggcctttaacaaaatcacaagaagccttcaagatcttcagcagaaagatattggtgtgaaaccggagttcagctttaacatacctcgtgccaaaagagagctggctcagctgaacaaatgcacctccccacagcagaagcttgtctgcttgcgaaaagtggtgcagctcattacacagtctccaagccagagagtgaacctggagaccatgtgtgctgatgatctgctatcagtcctgttatacttgcttgtgaaaacggagatccctaattggatggcaaatttgagttacatcaaaaacttcaggtttagcagcttggcaaaggatgaactgggatactgcctgacctcattcgaagctgccattgaatatattcggcaaggaagcctctctgctaaaccccctgagtctgagggatttggagacaggctgttccttaagcagagaatgagcttactctctcagatgacttcgtctcccaccgactgcctgtttaagcacattgcatcaggtaaccagaaagaagtggagagacttctgagccaagaggaccatgataaagataccgtccaaaagatgtgtcaccctctctgcttctgcgatgactgtgagaaactcgtctctgggaggttgaatgatccctcagttgtcactccattctccagagacgacagggggcacacccctctccatgtggctgctgtctgtgggcaggcatccctcatcgacctcctggtttccaagggcgccatggtaaatgccacagactaccatggggccactccgctccacctggcctgtcagaagggctaccagagcgtgacgctgctgctgctgcactacaaggccagcgcggaagtgcaggacaacaatgggaatacgccactccacctggcctgcacctacggccacgaggactgtgtgaaggctctggtttactacgacgtggagtcgtgcagacttgacattggcaatgagaaaggagacacccctctacacattgctgcccgctggggctaccaaggcgtcatagagacattgctgcagaacggagcgtccaccgagatccagaacagactgaaggagacgcccctcaagtgtgcattaaactcaaagattctgtctgtaatggaagcctatcacctgtccttcgagaggaggcagaagtcgtccgaggcccctgtgcagtccccgcagcgctccgtggactccatcagccaagagtcctccacttccagcttctcctccatgtcagccggctcaaggcaggaggagaccaagaaggactacagagaggtagaaaaacttttgagagcagttgctgatggagatctagaaatggtgcgttacctgttggaatggacagaggaggacctggaggatgcggaggacactgtcagtgcagcagaccccgaattctgtcacccgttgtgccagtgccccaagtgtgccccagctcagaagaggctggcgaaggttcctgccagtgggcttggtgtgaacgtgaccagccaggacggctcctccccgctgcatgtcgccgccctgcacggccgggcggacctcatccgcctcctgctgaagcacggggccaacgcaggtgccaggaacgcagaccaagccgtcccgctccacctggcctgccagcagggccactttcaggtggtgaagtgtctgttagattcgaatgcaaaacccaataagaaggacctcagtggaaacacgcccctcatttacgcctgctccggtggccatcacgagcttgtggcactgctgctacagcacggggcctccattaacgcttctaacaataagggcaacacagcgctgcacgaggctgtgattgaaaagcacgtcttcgtggtagagctgcttctgctccacggagcgtcagttcaggtgctgaacaagcggcagcgcacggctgtagactgtgctgaacagaattcaaaaataatggaattgcttcaggtggtaccaagctgtgttgcttcattagatgatgtggctgaaactgaccgcaaggagtatgtcactgttaagatcaggaaaaaatggaactcaaaactgtatgatctaccagatgagccttttacaagacagttttactttgtccactcagctggtcagtttaagggaaagacttcaagggagattatggcaagagatagaagtgtccctaatttaaccgaaggttctttgcatgagccagggaggcaaagtgtcacactgagacagaataacctgccagctcagagtggatctcatgctgctgagaaaggcaacagcgactggccagagaggcctggactgacacagactggccctggacacagacggatgctgcggagacacacggtagaggatgcggtcgtgtcccagggcccggaggctgctggccccctctccactccccaagaggttagtgcttcccggtcctaacaggaatgaggagttgttgaacccactgctaggaagcaaggatgcaacaagatgatgctgagcgtgaacacatctgagaactaaatgtgcttccatgagactggcttgagaagtcttcagcaccaagttcctgaaagcttttctgtggcaggaaagaatgcaacaaaaaagttaaccaccaccatctctctcctcttcaaagctaatgaatacaattgaaacagacaaaaattccagtagcatccagatccttaagccagaggtgcatgcttctttttaagtatgagggtttgttggtcacagtgggagaggtttcaccaccgcattctgacctcctcctcccaaaaggtgctaaacctctctgacctgtgtacattcacaaaccacagctagaattcctccacctaggattaagctggagagaagtaagtaatttaggtttcatggtactgtagaggccaggctgaaatgtcatatctgaaggaagaaagcagcagctggacaatgtttctttgcaaagcaacactcgaaccaaaagatgcctcaatcccattttgatattcattttagtgaaaggatgcatcagacctgttccacatcatgcacatgggaaagggtggttatcattttccttctaacaagtaggtacagatattcggttactacacgtgcacctgtagcagtatttctagaaacatccctttttgttgagaacctcccttgaatgtctgtcacactcacacctgacgggatggttactggattagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgatagggaaatggttttgtccatgttcttggaaatacttgtgtatgtacagaaggaagggagggattatttttctacaaagtaatttatgatttctaattttctaatgtgccttggatatgtgccaaatgatggaaaagaaacagtaaactttatgattcttaaaaaaaaaaaaaaaaaaaaaaaaaaaaaaaaaaaaaaaaaaaaaaaaaaaaaaaaaaaaaaaaaaaaaaaaaaaagg

SEQ ID NO: 37 - DNA, 1759 bp, Homo sapiens
cccctgcctctcggactcgggctgcggcgtcagccttcttcgggcctcggcagcggtagcggctcgctcgcctcagccccagcgcccctcggctaccctcggcccaggcccgcagcgccgcccgccctcggccgccccgacgccggcctgggccgcggccgcagccccgggctcgcgtaggcgccgaccgctcccggcccgccccctatgggccccggctagaggcgccgccgccgccggcccgcggagccccgatgctggcccggaggaagccggtgctgccggcgctcaccatcaaccctaccatcgccgagggcccatcccctaccagcgagggcgcctccgaggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaagctgatccaccttgagatcaagccggccatccggaaccagatcatccgcgagctgcaggtcctgcacgaatgcaactcgccgtacatcgtgggcttctacggggccttctacagtgacggggagatcagcatttgcatggaacacatggacggcggctccctggaccaggtgctgaaagaggccaagaggattcccgaggagatcctggggaaagtcagcatcgcggttctccggggcttggcgtacctccgagagaagcaccagatcatgcaccgagatgtgaagccctccaacatcctcgtgaactctagaggggagatcaagctgtgtgacttcggggtgagcggccagctcatagactccatggccaactccttcgtgggcacgcgctcctacatggctccggagcggttgcagggcacacattactcggtgcagtcggacatctggagcatgggcctgtccctggtggagctggccgtcggaaggtaccccatccccccgcccgacgccaaagagctggaggccatctttggccggcccgtggtcgacggggaagaaggagagcctcacagcatctcgcctcggccgaggccccccgggcgccccgtcagcggtcacgggatggatagccggcctgccatggccatctttgaactcctggactatattgtgaacgagccacctcctaagctgcccaacggtgtgttcacccccgacttccaggagtttgtcaataaatgcctcatcaagaacccagcggagcgggcggacctgaagatgctcacaaaccacaccttcatcaagcggtccgaggtggaagaagtggattttgccggctggttgtgtaaaaccctgcggctgaaccagcccggcacacccacgcgcaccgccgtgtgacagtggccgggctccctgcgtcccgctggtgacctgcccaccgtccctgtccatgccccgcccttccagctgaggacaggctggcgcctccacccaccctcctgcctcacccctgcggagagcaccgtggcggggcgacagcgcatgcaggaacgggggtctcctctcctgcccgtcctggccggggtgcctctggggacgggcgacgctgctgtgtgtggtctcagaggctctgcttccttaggttacaaaacaaaacagggagagaaaaagcaaaaaaaaaaaaaaaaaaaaaaaaaaaa

SEQ ID NO: 38 - DNA, 1133 bp, Homo sapiens
ggcacgaggctgggttccgaggcccaagcccttggcagtgtttgtgagtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgtcgggcgcggggctgggtgcggtcgtcgagggctggcggcggcggcgggaggacgcgcgggcggcgctgggactgctgggccggctgcccgtgctgcccgtggcggcggcagccgagttgccccctgtgcccgggggaccccgcggcccgggcgagttggccaagtacgggctgccggggctggcgcagctcaagagccgcgagtcgtacgtgctgtgctacgacccgcgcacccgcggcgcgctctgggtggtggagcagctgcgacccgagcgtctccgcggcgacggcgaccggcgcgagtgcgacttccgcgaggacgactcggtgcacgcgtaccaccgtgccaccaacgccgactaccgcggcagtggcttcgaccgcggtcacctggccgccgccgccaaccaccgctggagccagaaggccatggacgacacgttctacctgagcaaagtcgcgccccaggtgccccacctcaaccagaatgcctggaacaacctggagaaatatagccgcagcttgacccgcagctaccaaaacgtctatgtctgcacagggccactcttcctgcccaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggaaaaaaaa

SEQ ID NO: 39 - DNA, 1115 bp, Homo sapiens
ctttttgcgatgcctactggggactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggcttcgccttcatcagcttccaccgccgcgaggatcgtgcgcgtgccattgccggggtgtccggctttggctacgaccacctcatcctcaacgtcgagtgggccaagccgtccaccaactaagccagctgccaccgtgtactcggtccgggacccttggcgacagaagacagcctccgagagcgcgggctccaagggcaataaagcagctccactctcaaaaaaaaaaaaaaaaaaaaaaaaaaaaaaaaaaaaaaaaaaaaaaa

SEQ ID NO: 40 - DNA, 4172 bp, Homo sapiens
aggcagagagagtcgggttacaagatggcggatctgtagtagttaccgcggcggcgggagagcaagcgagccctggggggcaaagagacgggagagtgggtgtatgcgcgggtgaagtgagaggtaacggggcctccgggcggagaggcctcagtggctcttgtcaccccttctcgcggctgaacctttggagccatggtgaattcgggcctctccgaagccgccgccgccgccaccgccactactgcctttaccgtctcctaagagtgaggagcgcggacgaggtaagcgaggaggcggcggctagagcggtggagacagcagccaccatgtcggatacgcggcggcgagtgaaggtctataccctgaacgaagaccggcaatgggacgaccgaggcaccgggcacgtctcctccacttacgtggaggagctcaaggggatgtcgctgctggttcgggcagagtccgacggatcactactcttggaatcaaagataaatccaaatactgcatatcagaaacaacaggatacattaattgtttggtcagaagcagagaactatgatttggctctgagttttcaggagaaagctggctgtgatgagatctgggaaaaaatttgtcaggttcaaggtaaagacccatcagtggaagtcacacaggacctcattgatgaatctgaagaagaacgatttgaagaaatgcctgaaactagtcatctgattgacctgcccacatgtgaactcaataaacttgaagagattgctgacttagttacctcagtgctctcctcacctatccgtagggaaaagctggctctcgccttggaaaatgaaggctatattaaaaaactattgcagctgttccaagcttgcgagaacctagaaaacactgaaggcttacaccatttgtatgaaattattagaggaatcttattcctaaataaggcaactctttttgaggtaatgttttctgatgagtgtatcatggatgtcgtgggatgccttgaatatgaccctgctttggctcagccaaaaagacatagagaattcttgaccaaaactgcaaagttcaaggaagttataccaataacagactctgaactaaggcaaaaaatacatcagacttacagggtacagtacattcaggacatcattttgcccacaccatctgtttttgaagagaattttctttctactcttacgtcttttattttcttcaacaaagttgagatagtcagcatgttgcaggaagatgagaagtttttgtctgaagtttttgcacaattaacagatgaggctacagatgatgataaacggcgtgaattggttaattttttcaaggagttttgtgcattttctcagacattacaacctcaaaacagggatgcatttttcaaaacattggcaaaattgggaattcttcctgctcttgaaattgtaatgggcatggatgatttgcaagtcagatcagctgctacagatatattttcttatctagtagaatttagtccatctatggtccgagagtttgtaatgcaagaagctcagcagagtgatgacgatattcttcttattaatgtggtaattgaacaaatgatctgtgatactgatcctgagctaggaggcgctgttcagttaatgggacttcttcgtactctaattgatccagagaacatgctggctacaactaataaaaccgaaaaaagtgaatttctaaattttttctacaaccattgtatgcatgttctcacagcaccacttttgaccaatacttcagaagacaaatgtgaaaaggataatatagttggatcaaacaaaaacaacacaatttgtcccggtgcccttcgctttatgaggcggataattggacttaaagatgaattttataatcgttacatcaccaagggaaatctttttgagccagttataaatgcacttctggataatggaactcggtataatctgttgaattcagctgttattgagttgtttgaatttataagagtggaagatatcaagtctcttactgcccatatagttgaaaacttttataaagcacttgaatcgattgaatatgttcagacattcaaaggattgaagactaaatatgagcaagaaaaagacagacaaaatcagaaactgaacagtgtaccatctatattgcgtagtaacagatttcgcagagatgcaaaagccttggaagaggatgaagaaatgtggtttaatgaagatgaagaagaggaaggaaaagcagttgtggcaccagtggaaaaacctaagccagaagatgattttccagataattatgaaaagtttatggagactaaaaaagcaaaagaaagtgaagacaaggaaaaccttcccaaaaggacatctcctggtggcttcaaatttactttctcccactctgccagtgctgctaatggaacaaacagtaaatctgtagtggctcagataccaccagcaacttctaatggatcctcttccaaaaccacaaacttgcctacgtcagtaacagccaccaagggaagtttggttggcttagtggattatccagatgatgaagaggaagatgaagaagaagaatcgtcccccaggaaaagacctcgtcttggctcataaaatatttattaggggaccctcaacatgtggtcttacaatgctgcaactgttcagtgagctgaaaatctgaatcagaaagctttctcaattgaacttataaaatatacaaggagtagcaaaagacagtatatcagctaagagagtttagttctaataaaaatcaggcttcccaggaacttgattgcttgctagtaattaaggggtttgccttttaggctgtcaaaacaaacattagtaaccagaacctgggagacagcttctcagcaaggaaaagtcacaggtttggggacggtttaggggaggggaaaaggttgatataataatgcagggttgctcctcggggtgtcgatctagaaacaattttacagaacttcagttgtaaactcaataacattacttgtataatggtgctggccatgttgttgttttaatcagttgcctctttttaaaagaaatttttatggaaaacacattcaactatcattaaaaaaatgaagttaagctgttgggaccatttctttaagatttaacaaaagttcagccttttaggtagttgaagggaagtacaccccgtattcagcacatgttgagttttctacaccaggaattttcaatatgtatattgatgaaaacaagctcaattcaaactggacagttttaagataatgttaaaatcagcacttttagagacaacgaaggccaagaatcagtacagtagtattccaaaatgattttctctagaaatttgaaagtagatcgaacagaatgttgtcaaccgcctaccagtacaatcttttgtggaagatactttgaaatcactttctactttgttagtaaagttctgtctttccagagctgcaagttttaaagtgttacttatacagaccaaccaagaatagtgctgaattaagtggcatttagtatctagaagccattttgatccaagaagctacttaagtgtcaaagtcagcatgcagcacatgtagcttttctgtaaacaagggtgtgatatgaaagctgcttttttaagaagagtaaaagcacattccatatacgtaagtgaattttaaaaataaattgaggcaaacagttaagttttatttttagagcaacaagttaactgtaaatattttaatgttagtttgctcatctatgatctgagatcatgccgaagtgagaaaaatctccccaaaatacaatttaatgcattgggaaaaaaaaactttaacagtaattccagccacaatccttagatcacccttgtaatgtgttacgggtccatttttcctggaatcgtttaatctaaagcagtttcccctgttttggagattttgtagttaattttaattttggctattgtttggaaaagatgagctgtctgtgtagatatgaagtatagttttttccataaaacagatgtttattttgtattaaaaaataccactgtacttgttttacaccatttgtatacatgtggtgatattaatgctaaactgtaaaattcaggaattaaaatgtgaccctgtaattccaaaaaaaaaaaaaaaa

SEQ ID NO: 41 - DNA, 6113 bp, Homo sapiens
taatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtc

SEQ ID NO: 42 - DNA, 1105 bp, Homo sapiens
ggggcttgtgggtctttgagacccgaaaattgagagcgttttcgcactccagcggctgctcctggcggctctgcggccgtcaccatgccacagaatgaatatattgaattacaccgtaaacgctatggataccgtttggattaccatgagaaaaagagaaagaaggaaagtcgagaggctcatgaacgttcaaagaaggcaaagaaaatgattggtctgaaggctaagctttaccataaacagcgtcatgctgagaaaatacaaatgaaaaagactatcaagatgcatgaaaagagaaacaccaaacaaaagaatgatgaaaagacaccacagggagcagtacctgcctatctgctggacagagagggacaatctcgagctaaagtactttccaatatgattaaacagaaaagaaaagagaaggcgggaaaatgggaagtccctctgcctaaagtacgtgcccagggagaaacagaagtattaaaagttattcgaacaggaaagagaaagaagaaggcatggaagagaatggttactaaagtgtgctttgttggagatggctttacaagaaaaccacctaaatatgaaagattcatcaggccaatgggcttgcgtttcaagaaagcccatgtaacacatcctgaactgaaagccaccttttgcctaccaatacttggtgtaaagaagaatccctcatccccactgtatacaactttgggtgttattaccaaaggtactgtcattgaagtaaatgtgagcgaattgggccttgtgacgcaaggaggcaaagttatttggggaaaatatgcccaggttaccaacaatcctgaaaatgatggatgtataaatgcagtcttactggtttgacagcaatttcatatataattattgaggactacacaccaattgaagaaactgccattactgtgatgtttctgaatactaccaaacagccatacatgtctgcaatgaagagatttattaaattgtaaacattaaagtggtccagttttataaatggtctttattttgaaatacgctttgaccccatgttcataaaactgaatgattgaaaaaaagcaaatatacaaatatcctacttcat

SEQ ID NO: 43 - DNA, 1511 bp, Homo sapiens
cccaaagtaggctaggcctacggaagctgggtcttcttgctgtgaggtcgcgttccccagtgttacggagggtccttgaggcaggagtgaaaattgggtctgggggttagtcctggggtggaggtctgggcacgccgggtcggaccccctccatcttcggttttgcacaccccgctttccagcgcggagtcgcggcgggtagggcggcgtcgcgtgcgtgacgtcatccagcggcgcctcgcgaggctccagtggccttgacctcccgcggcgtgggaggctgcgcggcgatgctgcagttcgtccgggccggggcgcgggcctggcttcggcctaccggcagccagggcctgagttccctggcggaagaggcagcgcgtgcgaccgagaacccggagcaggtggcgagcgagggtctcccggagcccgtgctgcgcaaagtcgagctcccggtacccactcatcgacgcccagtgcaggcctgggtcgagtccttgcggggcttcgagcaggagcgcgtgggcctggccgacctgcaccccgatgttttcgccaccgcgcccaggctggacatactgcaccaggttgctatgtggcagaagaacttcaagagaattagctatgccaagaccaagacgagagccgaggtgcggggcggtggccggaagccttggccgcagaaaggcactgggcgggcccggcatggcagcatccgctctccgctctggcgaggaggaggtgttgcccatggcccccggggccccacaagttactactacatgctgcccatgaaggtgcgggcgctgggtctcaaagtggcactgaccgtcaagctggcccaggacgacctgcacatcatggactccctagagctgcccaccggagacccacagtacctgacagagctggcgcactaccgccgctggggggactccgtactcctcgtggacttaacacacgaggagatgccacagagcatcgtggaggccacctctaggcttaagaccttcaacttgatcccggctgttggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatcaaaaaaaaaaaaaaaaaaaaaaaaaaaaaaaaaaaaaaaaaaaaaaaaaaaaaaa

SEQ ID NO: 44 - DNA, 1820 bp, Homo sapiens
gagctccaagctggtttgaacaagccctgggcatgtttggcgggaagttggcttagctcggctacctgtggccccgcagttttgtagtccccgccttgtttctccccagaggcctctcaatcctccctccatgatcttcgcatagagcacagtaccccttcacacggaggacgcgatggctcccaagaaacgcccagaaacccagaagacctccgagattgtattacgccccaggaacaagaggagcaggagtcccctggagctggagcccgaggccaagaagctctgtgcgaagggctccggtcctagcagaagatgtgactcagactgcctctgggtggggctggctggcccacagatcctgccaccatgccgcagcatcgtcaggaccctccaccagcataagctgggcagagcttcctggccatctgtccagcaggggctccagcagtcctttttgcacactctggattcttaccggatattacaaaaggctgccccctttgacaggagggctacatccttggcgtggcacccaactcaccccagcaccgtggctgtgggttccaaagggggagatatcatgctctggaattttggcatcaaggacaaacccaccttcatcaaagggattggagctggagggagcatcactgggctgaagtttaaccctctcaataccaaccagttttacgcctcctcaatggagggaacaactaggctgcaagactttaaaggcaacattctacgagtttttgccagctcagacaccatcaacatctggttttgtagcctggatgtgtctgctagtagccgaatggtggtcacaggagacaacgtggggaacgtgatcctgctgaacatggacggcaaagagctttggaatctcagaatgcacaaaaagaaagtgacgcatgtggccctgaacccatgctgtgattggttcctggccacagcctccgtagatcaaacagtgaaaatttgggacctgcgccaggttagagggaaagccagcttcctctactcgctgccgcacaggcatcctgtcaacgcagcttgtttcagtcccgatggagcccggctcctgaccacggaccagaagagcgagatccgagtttactctgcttcccagtgggactgccccctgggcctgatcccgcaccctcaccgtcacttccagcacctcacacccatcaaggcagcctggcatcctcgctacaacctcattgttgtgggccgatacccagatcctaatttcaaaagttgtaccccttatgaattgaggacgatcgacgtgttcgatggaaactcagggaagatgatgtgtcagctctatgacccagaatcttctggcatcagttcgcttaatgaattcaatcccatgggggacacgctggcctctgcaatgggttaccacattctcatctggagccaggaggaagccaggacacggaagtgagagacactaaagaaggtgtgggccagacaaggccttggagcccacacatgggatcaagtcctgcaagcagaggtggtgatttgttaaagggccaaaagtatccaaggttagggttggagcaggggtgctgggacctggggcactgtgggactgggacacttttatgttaatgctctggacttgcctccagagactgctccagagttggtgacacagctgtcccaagggcccctctgtatctagcctggaaccaaggttatcttggaactaaatgacttttctcctctcagtgggtggtagcagagggatcaagcagttatttgatttgtgctcttttgatatggccaataaaaccataccg

SEQ ID NO: 45 - DNA, 821 bp, Homo sapiens
tccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagttccggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgt

SEQ ID NO: 46 - DNA, 2189 bp, Homo sapiens
gcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaaaaa

SEQ ID NO: 47 - DNA, 2991 bp, Homo sapiens
ctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 48 - DNA, 4243 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacaggcctggatggggaaagagtcctgctgttgatcctcacatgtttcctgggcacctaactctgtcagccactgccagggaccaaggatccagcatccatggcacccctggttcctgccatcctggggtacccgattcaaagaaggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcagcctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaaaaaaaaaaaaaaaaaaaaaaaaaaaaaaaaaaaaaa

SEQ ID NO: 49 - DNA, 4180 bp, Homo sapiens
gaggagccgagttagctcagccaggcggcgacttcggcggcgccacgagagcgggcagcggaggagattgacgtgagtgaattcagatataactcaagcttgttagagggctttttaaaaataaaaagttgattccgtgcaagagagcaagttactgctgcttaccgttcagagacttacaggtgcttgcctgcattgcaataaaggactcatttattgagcaagacttatatttatctcttcattttggagagcctaataaactgttattacagtttctctactgactttcaaaagttttgaagtttgaaagacctttgcaattaaaacagcatgagcacggccagaacagagaaccctgttataatgggtctgtccagtcaaaatggtcagctgagaggccctgtgaaacccactggtggccctggaggagggggcacacagacacagcaacagatgaaccagctgaaaaacaccaacacaatcaataatggcactcagcagcaagcacagagtatgaccaccactattaaacctggtgatgactggaaaaagactttaaaactccctccaaaggatctaagaatcaaaacttcggatgtgacctccacaaaaggaaatgagtttgaagattactgtttgaaacgggagttactgatgggaatttttgaaatgggctgggaaaagccatctcctattcaggaggagagcattcccattgctttatctggtagggatatcttagctagagcaaaaaatggaacaggcaagagcggtgcctacctcattcccttacttgaacggctagacctgaagaaggacaatatacaagcaatggtgattgttcccactagagaacttgctctacaggtcagtcaaatttgcatccaggtcagcaaacacatgggaggggccaaagtgatggcaaccacaggaggaaccaatttacgagatgacataatgaggcttgatgatacagtgcacgtggtgattgctacccctgggagaatcctggatcttattaagaaaggagtagcaaaggttgatcatgtccagatgatagtattggatgaggcagataagttgctgtcacaggattttgtgcagataatggaggatattattctcacgctacctaaaaacaggcagattttactatattccgctactttccctcttagtgtacagaagttcatgaattcccatttgcagaaaccctatgagattaacctgatggaggaactaactctgaagggagtaacccagtactacgcatatgtaactgagcgccaaaaagtacactgcctcaacacacttttctccaggcttcagataaaccagtcgatcattttctgtaactcctctcagcgagttgaattgctagccaagaagatttctcaactgggttattcttgcttctatattcatgctaaaatgaggcaggaacatcgaaatcgtgtatttcatgatttccgaaatggcttatgccgcaatcttgtttgcactgatctgtttacccgaggtattgatatacaagctgtgaatgtggtaataaactttgatttcccaaagctggcagagacctatctccatcgtattggaagatcaggtcgctttggtcatcttggcttagccatcaacttgatcacatatgatgatcgcttcaacctgaaaagtattgaggagcagctgggaacagaaattaaacctattccgagcaacattgataagagcctgtatgtggcagaataccacagcgagcctgtagaagatgagaaaccttaacaagcatgctttgacaaattacaaaaggctcgtttggatctgtgacacatcgttttggggggaatgctcttctctttgtgggtttttcatcttttattttggaactatgaagacttagagctcagacattttctttttttaactggtgaagagaaaaaggctgaaaagaaggaatataccttttttgttccacttgtttgcactgtgtgctgactgaacattagttgcactaactgctggtttttaaaaaatgttttctggggaaaggggacaaggaaggaaaagaaagaagagaaggggagaaaccctaaaaagagaagaatcttaatgaacacacaagcttgtcaatgatttcaaaattctccaacagctgactctcgtgcatttcaacttctccctgattcctcatccgttttttaagcctgaagagcttattacttatttgtgcgaagtgccttatgctatgagaccattcagaatatcatcttttagacacagcccgaggaatcaacaatagtaactctttctttcctttttttttctttttcttttaaaaaatgtctttttattttggtttcaggttgaagtctcttccctttctacccagtactcgagcccagggctagaagttgaaactcactagtaatgttaaacaccattttttttttctttttggggaggagttgatatgcaactgcagttcatccgcactgtaaatacatgtatttaaaaaaacaatcccaagtaaaaatttcttctgggctgagtagataaaaaacatcatcgctcccaaaggaaagagcagtctatcattgcaggagccatatgacaagcctttgtgctctatagcagacactaaagactgggttacatatgcctccagtagtagtatggcacttgatgtgtagacatgtcagagccttggccctctttcctctgtggcaaagcgtgtcccatagaaaattgggtgtgtatacttgtataaactttgtaaataagttttttttctgggttcatatatatatatatatatacatatatatatattttttttttggatgaaggttgctgggattaaggggattagagtgattatgggagcagctaaagatgagaggggctcagttttacgcaacactaaattctagaaagtactttggcctcgtgctgtagagagcagatttctatggtaccctgtgttagtaaaggggcccagaaatctgggatgtactgtttgctgccacactgtctcatctagtacctttggagtaggtttaccagagagagcaaggaagcttcaaaacattgataattcaagatttattttgagaagctctgattttgcttcttccccctttctaaaagtttgaggaatatttcaagctctgcaacagggggcaaagattaatctaccttgcagtgtaggaattctattgagtggcagtgtcattgagcagtatatatataaagcacagatttgcatttcagaatattagccagtaccagctttggtaatgttagcagttctggagcttaattttctgtggatcatttcctgtagtgtgtaaatgtgttgccctctgcccgctttgatacataaacttttgcaggaatgggcaacctgagagctgttaactttcatgctacagaaagctgcttgccattctcttgcattgtgacaagaattgttacctgtcattttgcactgtaaattgctggcagatgctttacagtcaatagtgttgctttaaattgtgcccctcccaacatgcttgatgtttggcctgatctccaggcaaaaggagtgagatgaatcaaaaccagtgaacttttttttttaatgtttttaattcccttttaacccagtgtactaggtcaatcaggaggcatctggaaagggggggaaaaaagcaaaaaacaaaattaaaaaaaattgatttccatattttttcaaaaccctaaaatattacaaaataagtcccgcatatactttaatgttttaactcttttggacaaaggaatcaattacttgaagttgcttttttgactctgcctacttctgagcaaactatttgcgactcacccacaattccttggagatcaaaatcctgcagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagaggg

SEQ ID NO: 50 - DNA, 1744 bp, Homo sapiens
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatccaaaaaaaaaaaaaaaaaa

SEQ ID NO: 51 - DNA, 3767 bp, Homo sapiens
gcggccgcagctccgtttccggtggctcgtcgcgctcgctcactccagctgcagccactctcgcccgtggctgcttcctccatcctggtattttttggagcttccatcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagctgatccatccgttgtctagatttgagtatgagcacagtggaagaggattctgacacagtaacagtagaaactgtgaactctgtgactttgactcaggacacagaagggaatctcattcttcactgccctcagaatgaagcggatgaaatagactcagaagatagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaagatgctacagaaatcatctttgagatgtcaaaagacgaaagaaaagatttctacaggactatagcatggggtctgaaccggcctttgtttgcagtttatagaagagtgcttcgcatgtatgatgacagaaaccatgtgggaaaatatacacctgaagaaattgagaagctcaaggagctccggataaagcatggcaatgactgggcaacaataggggcggcgctaggaagaagtgcatcttctgtcaaagatcggtgccgactgatgaaggatacttgcaacacagggaagtggacagaagaagaagaaaagagacttgcagaagtggttcatgagttgacaagcactgagccaggtgacatagtcacacagggtgtgtcttgggcagctgtggctgaacgagtcggtacccgctcagaaaagcaatgtcgttctaaatggctcaactacctgaattggaaacagagtgggggtactgaatggaccaaggaagatgaaatcaatctcatcctcaggatagcagaacttgatgtagctgatgaaaatgacattaactgggatctgttagctgagggatggagtagtgtccgttcaccacaatggctacgaagtaaatggtggaccatcaaaaggcaaattgcaaaccataaggatgtttcgttccctgtcttaataaaaggtcttaaacagttacatgagaaccaaaaaaacaacccaacgcttttggagaataaatcaggatctggagttccaaacagtaataccaattccagtgtgcagcatgttcagataagagttgcccgcttggaagataatacagccatctcttctagccccatggcagcattgcagattccagtccagatcacccatgtttcttcagcagactctcctgctaccgttgactcagaaacaataacactaaacagtggaacactacagacatttgagattcttccctctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccccagaacatttgttgaacacaagtgataatgttacagtgcagtgtcacacaccaagagtcatcattcagactgttgccacagaggacatcacttcttccatatcccaagcagaactgacagtcgatagtgatattcagtcatctgattttcctgagcctccagacgccctagaagcagacactttcccagatgaaattcatcaccctaagatgactgtggagccatcatttaatgatgctcatgtatccaaattcagtgaccaaaatagcacagaactgatgaatagtgttatggtcagaacagaagaagaaatctctgacaccgaccttaaacaagaggaatcaccctctgatttagccagtgcttatgttactgagggtttagagtctcccactatagaagaacaagttgatcaaacaattgatgatgaaacaatacttatcgttccttcaccacatggctttatccaggcatctgatgttatagatactgaatctgtcttgcctttgacaacactaacagatcccatactccaacatcatcaggaagaatcaaatatcattggatcatccttgggcagtcctgtttcagaagattcaaaggatgtcgaagatttggtaaactgtcattagaataattcttagaaataggcagttcaagcaaagaaggcacactgttaattacaacctcttcaaagaaataggagcaaacccccaagaggcttaatttaccaatttaaatagccacagtccttaagccacacacattgttgctgctatgactttttacctcctttaaacacatcatctgaggttgagttttatgacagtatgtagttgagtggaggctgggagttttaagcataaatccctgtttagtgttacatgggaataaggaatttcattcacttcagccactaagaaaagtttagaatcacgaaagcttaactgctgtggtttaaagtacagtttctctaaagatcagacatggcactgtctcctctcaagcctggttgtagttcagatgagtcttttcaacatggtcttcaacatggtctagagcttaccagtgatcttctgatcttcaagaagactaagtttgagacttgaccagcatacaagtatagagacctaggaggtggtcttgtggtggtacatttggttaacccattgctggcagtgggagctgatttaggcagggtaaacaggaaagcattaaaagttaaaattcactacaggttttttgttacttttaaagggaatatggataagcatagtaacaaaacccaccagaatctaagcagttttcaccccctcagaaaccactgtcattagtttacaaagttagcactttgaagtaaaactaaatgaggaaggaagtaatgttacctatccttgataccatgaccatttattagatgttttgctatataaattaccgagagaatagtttgtcatccacttagtgtgttagctggtggggtacaatataacctctcatctcaggctattttaaaaaaacaatatttgcttctataacaaaaggaaacaaatctaagaatcattcctgtactacagaagggttaaggcaaaggtagccttttgggctttttaatgaatatgacccctatagaaaagtcaagaaaaaaaaacccttgtataaattattttatttattattgtaattagatcttcacaaagttgtcttttcactgtgttttgtcaacgtgaaattaaattgtagttataagcaaaagttggttgcctagggaacaattgtatattcagtttaacagaaataaaagaatatttgtcttaaaaaaaaaaaaaaaaaaactcgag

SEQ ID NO: 52 - DNA, 1371 bp, Homo sapiens
gcggtggcggcggcggcggcggcgcgtggcaggtccggcgggcgcgaggcggcggcggaggcccgagcccggcccagcctcgtcccgcccggagcccgcctggctgctaccccgaccccggctccggtcccgtcctgtcccggcgcgccgcggcctcgccccggcccccgctcggcgcctcccgagggagcggcgctgccggccgagagcgcaggcccggccatgaccgacttcaaattgggtatcgtgcggctcggccgggtggccgggaagaccaaatacacgctgatcgatgagcaggacatcccgctggtggagagctactcctttgaggcccgaatggaagtggatgcagatggaaatggtgctaagatatttgcctatgcctttgacaagaaccgaggaaggggctctgggagactccttcatgagctgctgtgggagcggcaccgggggggcgtggccccgggcttccaggtggtgcacctcaacgctgtgaccgtggacaatcgcctggacaacctgcaactggtgccgtggggctggcggcccaaggctgaagagacctccagcaagcagagggagcaaagcttgtattggcttgcaattcagcagctgcctacagaccctatagaagaacagtttcctgtcctaaatgtgacccggtattataatgccaacggggatgtagtggaagaggaggagaactcttgcacctactatgagtgccactaccctccctgcacagtgattgagaagcagctccgggagttcaacatctgtgggcgctgccaggtggcccggtactgcggctcccagtgccagcagaaggactggcctgcccacaagaagcactgtcgggagaggaagcgtcccttccagcatgagcttgagccagagcgatgacgggcaggggagccacacatactcacagcccccgggctctaccctgggcacagcagagacagactggtggttgaacctggaggtgccaaaaaagccagctgcgggcccaggacagctgccgtgagactcccgatgtcacaggcagtctgtgtggttacagcgcccctcagtgttcatctccagcagagacaacggaggaggctcccaccaggacggttctcattatttatatgttaatatgtttgtaaactcatgtacagttttttttgggggggaggcaatgggaagggtagaaattacaaatagaatcatttgctgtaatccttaaatggcaaacggtcaggccacgtgactaaaaactgtcctgttgtcgaagcttctcccctgggccgccgggagccccgtggagcgcggcctgcacgggagttgtgtccacaaaggcaaagtaaaggggtggaatcatca

SEQ ID NO: 53 - DNA, 1693 bp, Homo sapiens
ggcggggtttcccgcgctcggcggaagcggaaggggcggggctccgcgctcctagtctccactgctgccgccgtcgccgccacccgagccggagcgggctgggccgccaaggcaagatggtggactacagcgtgtgggaccacattgaggtgtctgatgatgaagacgagacgcaccccaacatcgacacggccagtctcttccgctggcggcatcaggcccgggtggaacgcatggagcagttccagaaggagaaggaggaactggacaggggctgccgcgagtgcaagcgcaaggtggccgagtgccagaggaaactgaaggagctggaggtggccgagggcggcaaggcagagctggagcgcctgcaggccgaggcacagcagctgcgcaaggaggagcggagctgggagcagaagctggaggagatgcgcaagaaggagaagagcatgccctggaacgtggacacgctcagcaaagacggcttcagcaagagcatggtaaataccaagcccgagaagacggaggaggactcagaggaggtgagggagcagaaacacaagaccttcgtggaaaaatacgagaaacagatcaagcactttggcatgcttcgccgctgggatgacagccaaaagtacctgtcagacaacgtccacctggtgtgcgaggagacagccaattacctggtcatttggtgcattgacctagaggtggaggagaaatgtgcactcatggagcaggtggcccaccagacaatcgtcatgcaatttatcctggagctggccaagagcctaaaggtggacccccgggcctgcttccggcagttcttcactaagattaagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggaactccagaagtgcttcgatgtgaaggacgtgcagatgctgcaggacgccatcagcaagatggaccccaccgacgcaaagtaccacatgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctcaaaaaaaaaaaaaaaaaaaaaa

SEQ ID NO: 54 - DNA, 2236 bp, Homo sapiens
cccttctgaaaaatggtttcacccgctccgtctctagaacgggtcgggccgctaccactgtccggcccggaggggaactgttttctccggaagtgacaacacgctgactaggaaaaggaggaggcggggcagtggggccttcggcggcgactatggaaggagccggctacagggtggtgtttgagaagggcggagtgtacctgcacaccagcgctaagaagtatcaggaccgagactctctcatcgctggtgtcatccgtgtcgtggaaaaggacaatgacgtcctcctgcactgggctcctgtagaggaggctggagattccacccaaatcctcttctccaagaaggactccagtgggggtgactcatgtgcttctgaggaggaaccaacctttgaccccggctatgaacctgactgggctgtcatcagcactgtgcggccacagccctgccactcagagcccacgagaggtgcagagcccagctgcccccagggctcctgggccttctcagtgagtctgggggagctaaagtccatccgccgctccaagccaggcctcagctgggcctacctggttctggtgacccaggctggaggttccctgcccgcactgcacttccaccgcgggggcacccgcgccctgctccgcgtcctcagccgctacctgctgttggccagctccccgcaggactcccgcctctaccttgtcttcccccacgactcctctgctctctccaactccttccaccacctgcagctctttgaccaggacagctccaatgtggtgtcacgcttcctccaggatccctactccaccaccttcagcagcttctcccgagtgaccaacttcttccggggtgccctgcagccacagcctgagggagccgcctccgaccttcccccgccacccgacgatgagcccgagcctggattcgaggtcatttcctgtgtggagctggggcctcggccaaccgtggagcggggccctccagttacagaggaggagtgggcacgccacgtgggccctgaaggtcgcctgcagcaggtccctgagctgaagaaccggatcttctcggggggtctgagccccagcctgcggcgcgaggcctggaagttcctcctagggtacctcagctgggaaggcacagctgaggagcacaaggcccacatacgcaagaaaacggatgagtatttccgcatgaagctgcagtggaaatctgtgagccctgagcaggagcggagaaactcacttctgcatggataccgcagcctcatcgaaagggatgtgagccgcactgacaggaccaacaagttctacgagggtcccgagaacccggggctgggcctgctgaacgatatcctcctcacctactgcatgtatcacttcgacctcggctacgtccagggcatgagtgatcttctctccccgatcctctacgtcattcagaacgaggtggatgctttctggtgtttctgtggcttcatggagctcgtgcaagggaactttgaagagagccaggagaccatgaagcggcaactcgggcgactgctgctgctcctgagggtgctggaccccctgctctgcgacttcctggattcccaggactccggctctctctgcttctgtttccggtggctgctcatctggttcaagagggaattccccttcccggatgtccttcggctgtgggaggtgctgtggacagggctccctggccccaatctgcacctgctggtggcctgcgccatcctggacatggagagggacaccctcatgctgtccggcttcggctccaatgagatcctcaagcacatcaacgagctgactatgaagctgagcgtggaggacgtgctgacccgcgccgaggccctgcaccgccagctaaccgcctgccccgagctgccccacaacgtgcaggagatcctggggctggccccgcccgcagagccccacagcccctcgcccaccgcctccccgctgcctctgtcgcccacccgggccccgcccaccccgccgccctccacggacacagccccgcagcccgacagcagcctggagatcctgcccgaggaggaggacgagggcgccgactcctaaccccgccaggcagcctcgttctgcacaggcactttagcccgagccaggcacacctgcgagggggcaggtgtgctccgccgccctgctgataagctggcttcattaaactgacacttctcaaaaaaaaaaaaaaaaaa

SEQ ID NO: 55 - DNA, 3090 bp, Homo sapiens
gaattccgggcccggatagccggcggcggcggcggcggcggcggcggcggcggccgggagaggcccctccttcacgccctgcttctctccctcgctcgcagtcgagccgagccggcggacccgcctgggctccgaccctgcccaggccatggccggcaacgtgaagaagagctctggggccgggggcggcacgggctccgggggctcgggttcgggtggcctgattgggctcatgaaggacgccttccagccgcaccaccaccaccaccaccacctcagcccccacccgccggggacggtggacaagaagatggtggagaagtgctggaagctcatggacaaggtggtgcggttgtgtcagaacccaaagctggcgctaaagaatagcccaccttatatcttagacctgctaccagatacctaccagcatctccgtactatcttgtcaagatatgaggggaagatggagacacttggagaaaatgagtattttagggtgtttatggagaatttgatgaagaaaactaagcaaaccataagcctcttcaaggagggaaaagaaagaatgtatgaggagaattctcagcctaggcgaaacctaaccaaactgtccctcatcttcagccacatgctggcagaactaaaaggaatctttccaagtggactctttcagggagacacatttcggattactaaagcagatgctgcggaattttggagaaaagcttttggggaaaagacaatagtcccttggaagagctttcgacaggctctacatgaagtgcatcccatcagttctgggctggaggccatggctctgaaatccactattgatctgacctgcaatgattatatttcggtttttgaatttgacatctttacccgactctttcagccctggtcctctttgctcaggaattggaacagccttgctgtaactcatcctggctacatggcttttttgacgtatgacgaagtgaaagctcggctccagaaattcattcacaaacctggcagttatatcttccggctgagctgtactcgtctgggtcagtgggctattgggtatgttactgctgatgggaacattctccagacaatccctcacaataaacctctcttccaagcactgattgatggcttcagggaaggcttctatttgtttcctgatggacgaaatcagaatcctgatctgactggcttatgtgaaccaactccccaagaccatatcaaagtgacccaggaacaatatgaattatactgtgagatgggctccacattccaactatgtaaaatatgtgctgaaaatgataaggatgtaaagattgagccctgtggacacctcatgtgcacatcctgtcttacatcctggcaggaatcagaaggtcagggctgtcctttctgccgatgtgaaattaaaggtactgaacccatcgtggtagatccgtttgatcctagagggagtggcagcctgttgaggcaaggagcagagggagctccctccccaaattatgatgatgatgatgatgaacgagctgatgatactctcttcatgatgaaggaattggctggtgccaaggtggaacggccgccttctccattctccatggccccacaagcttcccttcccccggtgccaccacgacttgaccttctgccgcagcgagtatgtgttccctcaagtgcttctgctcttggaactgcttctaaggctgcttctggctcccttcataaagacaaaccattgccagtacctcccacacttcgagatcttccaccaccaccgcctccagaccggccatattctgttggagcagaatcccgacctcaaagacgccccttgccttgtacaccaggcgactgtccctccagagacaaactgccccctgtcccctctagccgccttggagactcatggctgccccggccaatccccaaagtaccagtatctgccccaagttccagtgatccctggacaggaagagaattaaccaaccggcactcacttccattttcattgccctcacaaatggagcccagaccagatgtgcctaggctcggaagcacgttcagtctggatacctccatgagtatgaatagcagcccattagtaggtccagagtgtgaccaccccaaaatcaaaccttcctcatctgccaatgccatttattctctggctgccagacctcttcctgtgccaaaactgccacctggggagcaatgtgagggtgaagaggacacagagtacatgactccctcttccaggcctctacggcctttggatacatcccagagttcacgagcatgtgattgcgaccagcagattgatagctgtacgtatgaagcaatgtataatattcagtcccaggcgccatctatcaccgagagcagcacctttggtgaagggaatttggccgcagcccatgccaacactggtcccgaggagtcagaaaatgaggatgatgggtatgatgtcccaaagccacctgtgccggccgtgctggcccgccgaactctctcagatatctctaatgccagctcctcctttggctggttgtctctggatggtgatcctacaacaaatgtcactgaaggttcccaagttcccgagaggcctccaaaaccattcccgcggagaatcaactctgaacggaaagctggcagctgtcagcaaggtagtggtcctgccgcctctgctgccaccgcctcacctcagctctccagtgagatcgagaacctcatgagtcaggggtactcctaccaggacatccagaaagctttggtcattgcccagaacaacatcgagatggccaaaaacatcctccgggaatttgtttccatttcttctcctgcccatgtagctacctagcacaccatctccctgctgcaggtttagaggaccagtgagttgggagttattactcaagtggcacctagaagggcaggagttcctttggtgacttcacagtgaagtcttgccctctctgtgggatatcacatcagtggttccaagatttcaaagtggtgaaatgaaaatggagcagctagtatgttttattattttatgggtcttgagtgcatttgaaggtg

SEQ ID NO: 56 - DNA, 3677 bp, Homo sapiens
cgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaactctatcacaatttgaaaagataagcaaaagtttgatttccagacactacagaagaagtaaaaatgcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctggggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgctgtaacagaagacaagtacgaaatactgcaatctgtcgacgatgctgcgattgtgataaaaaacacaaaagagcctccattgtccctgaccatccacctgacatcccctgttgtcagagaagaaatggagaaagtattagctggagaaacgctatcagtcaacgaccccccggacgttctggacaggcagaaatgccttgctgccttggcgtccctccgacacgccaagtggttccaggccagagccaacgggctgaagtcttgtgtcattgtgatccgggtcttgagggacctgtgcactcgcgtgcccacctggggtcccctccgaggctggcctctcgagctcctgtgtgagaaatccattggcacggccaacagaccgatgggtgctggcgaggccctgcggagagtgctggagtgcctggcgtcgggcatcgtgatgccagatggttctggcatttatgacccttgtgaaaaagaagccactgatgctattgggcatctagacagacagcaacgggaagatatcacacagagtgcgcagcacgcactgcggctcgctgccttcggccagctccataaagtcctaggcatggaccctctgccttccaagatgcccaagaaaccaaagaatgaaaacccagtggactacaccgttcagatcccaccaagcaccacctatgccattacgcccatgaaacgcccaatggaggaggacggggaggagaagtcgcccagcaaaaagaagaagaagattcagaagaaagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgagcaggggccgatcctgacaaagcacggcaagaacccagtcatggagctgaacgagaagaggcgtgggctcaagtacgagctcatctccgagaccgggggcagccacgacaagcgcttcgtcatggaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtgctgggtatggaagctatgggtacggaggcaactcggcgacagcaggctacagtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagc

SEQ ID NO: 57 - DNA, 1603 bp, Homo sapiens
gtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacactaaaaaaaaaaaaaaaaaaaa

SEQ ID NO: 58 - DNA, 2684 bp, Homo sapiens
aataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgagcggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgtgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgcattattcaactttgatttgggttgtaaaatgtgttaaatcctgttcattgaactcccatcaactcttatgaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagt

SEQ ID NO: 59 - DNA, 2178 bp, Homo sapiens
tttttttcccggctgggctcgggctcagctcgactgggctcggcgggcggcggcggcggcgccggcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggtacgtggctacaccactggctgccctcttgaacataaaggagaaaactcggctgcgggcacctcccaacgccaccttggaacatttctacctgaccagtggcaagcagcccaagcaggtggaagtagagcttttgtcccggcagagcgggctctctggccgccaggtagagcgttggttccgtcgccgccgcaaccaggaccggcccagtctcctcaagaagttccgagaagccagctggagattcacattttacctgattgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcatcgtcttcgccattgtttttatcatcacccgactggtcatcctgcccttctggatcctgcattgcaccctggtgtacccactggagctctatcctgccttctttggctattacttcttcaattccatgatgggagttctacagctgctgcatatcttctgggcctacctcattttgcgcatggcccacaagttcataactggaaagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattattccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggtttttttttaaaattaaaagattaaataaaaaatattaaataaaacatggcaataagtgtcagactattaggaattgagaagggggatcaactaaataaacgaagagagtctttcttaaaaaaaaaaaaaaaaaaaaaa

SEQ ID NO: 60 - DNA, 3465 bp, Homo sapiens
ctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggggacggcaaaacagaacagaaaggcggagataaaaagaggggtgttaaaagaccacgagaagatcatggccgtggatattttgagtacattgaagagaacaagtatagcagagccaaatctcctcagccacctgttgaagaagaagatgaacacttcgatgacacagtggtttgtcttgatacttataattgtgatctacattttaaaatatcaagagatcgtctcagtgcttcttcccttacaatggagagttttgcttttctttgggctggaggaagagcatcctatggtgtgtcaaaaggcaaagtgtgttttgagatgaaggttacagagaagatcccagtaaggcatttatatacaaaagatattgacatacatgaagttcgtattggctggtcactaactacaagtggaatgttacttggtgaagaagaattttcttatgggtattctctaaaaggaataaaaacatgcaactgtgagactgaagattatggagaaaagtttgatgaaaatgatgtgattacatgttttgctaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagttgtgatgatgattggcttgccaggagctggaaaaactacctgggttactaaacatgcagcagaaaatccagggaaatataacattcttggcacaaatactattatggataagatgatggtggcaggttttaagaagcaaatggcagatactggaaaactgaacacactgttgcagagagccccccagtgtcttgggaaatttattgagattgctgcccgaaagaagcgaaattttattctggatcagacaaatgtgtctgctgctgcccagaggagaaaaatgtgcctgtttgcaggcttccagcgaaaagctgttgtagtttgcccaaaagatgaagactataagcaaagaacacagaagaaagcagaagtagaggggaaagacctaccagaacatgcggtcctcaaaatgaaaggaaactttaccctcccagaggtagctgagtgctttgatgaaataacctatgttgaacttcagaaggaagaagcccaaaaactcttggagcaatataaggaagaaagcaaaaaggctcttccaccagaaaagaaacagaacactggctcaaagaaaagcaataaaaataagagtggcaagaaccagtttaacagaggtggtggccatagaggacgtggaggattcaatatgcgtggtggaaatttcagaggaggagcccctgggaatcgtggcggatataataggaggggcaacatgccacagagaggtggtggcggtggaggaagtggtggaatcggctatccataccctcgtgcccctgtttttcctggccgtggtagttactcaaacagagggaactacaacagaggtggaatgcccaacagagggaactacaaccagaacttcagaggacgaggaaacaatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaaaaaaaaaaaaaaaaaaaaaaaaaaaaaaaaaaaa

SEQ ID NO: 61 - DNA, 2409 bp, Homo sapiens
agcggggcagacctgcaccgggccaggcaagatggcggccatggagaccgagacggcgccgctgaccctagagtcgctgcccaccgatcccctgctcctcatcttatcctttttggactatcgggatctaatcaactgttgttatgtcagtcgaagacttagccagctatcaagtcatgatccgctgtggagaagacattgcaaaaaatactggctgatatctgaggaagagaaaacacagaagaatcagtgttggaaatctctcttcatagatacttactctgatgtaggaagatacattgaccattatgctgctattaaaaaggcctgggatgatctcaagaaatatttggagcccaggtgtcctcggatggttttatctctgaaagagggtgctcgagaggaagacctcgatgctgtggaagcgcagattggctgcaagcttcctgacgattatcgatgttcataccgaattcacaatggacagaagttagtggttcctgggttattgggaagcatggcactgtctaatcactatcgttctgaagatttgttagacgtcgatacagctgccggaggattccagcagagacagggactgaaatactgtctccctttaactttttgcatacatactggtttgagtcagtacatagcagtggaagctgcagagggccgaaacaaaaatgaagttttctaccaatgtccagaccaaatggctcgaaatccagctgctattgacatgtttattataggtgctacttttactgactggtttacctcttatgtcaaaaatgttgtatcaggtggcttccccatcatcagagaccaaattttcagatatgttcacgatccagaatgtgtagcaacaactggggatattactgtgtcagtttccacatcgtttctgccagaacttagctctgtacatccaccccactatttcttcacataccgaatcaggattgaaatgtcaaaagatgcacttcctgagaaggcctgtcagttggacagtcgctattggagaataacaaatgctaagggtgacgtggaagaagttcaaggacctggagtagttggtgaatttccaatcatcagcccaggtcgggtatatgaatacacaagctgtaccacattctctacaacatcaggatacatggaaggatattataccttccattttctttactttaaagacaagatctttaatgttgccattccccgattccatatggcatgtccaacattcagggtgtctatagcccgattggaaatgggtcctgatgaatatgaagagatggaagaagaggaggaggaggaagaggaggaagacgaggatgatgattcagcagatatggatgaatcagatgaagatgatgaagaggagagacggaggagagtctttgatgttcccattcgcagacgccgctgctcacgccttttttagcaagccttctgctgatggaagcactaggatgattctaggctgttaaatagatttctcaataatgtaaataactaaattgttctctgcatatagcaggaaaactagcatgaaatattgtttcaggccctgggttctatgtgacactacattaggaattggattgtttgggtttgctttgtgtttttgaggtagaggaagaaatgggaatcttttttttctcttccaggagtcagtggaagaatagttctctagctaaggaacggacatacctttgttttaaaatattttatacttacaaaaatctagaaatggagagggaactgttttgaataaggatttaaaatacctgcacaaggatagagagaaactatgtgactcattctgtgaaaagacttcttgcagttgtgagttatttagaaatgatcaaaatttgtaattaggctaatccatttagtgattcctaatattttgtactcacagagaactaattgactaaacaacttgaacgctagtggtttgtccttagacaatctgtctttgaatttaaagtctttatcgctaagaccttgactttaaatttttcatcactacaaccttgaatttaatttcaggtcttcaacatgatgaccttggatttaatttaaagtcttcaacactatgcgctttatcatattattcacagatgcatttttgaaatgtagtatgtaaaagtatgtaacgtgctgtttattaacaaaagattgttcacaacatctcatgtagtttaaatttgtaaatactgcttctgttttgtttctcctttatacacttgactgtctttgtgataagtgacatgaattttatgttaggattaagtatgttttcctgaaacttggattttttttgtaattatataattgagagttaagaatgaaatccttcaagtgttaaaaactcacattttaaaagcaaattttggttcc

SEQ ID NO: 62 - DNA, 1767 bp, Homo sapiens
cagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaaaaaa

SEQ ID NO: 63 - DNA, 1100 bp, Homo sapiens
acgaggaggggcgacgacgagctgcgagcaaagatgtgccccgggacccccggcaccttccagtggatttccttgcggaaaggatgttggcggtccctgtgacctgtggagacacggccagatctgccctccagcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgagattcctgggaacaccaccatggagggcctggcctttggcggtggacagtctgtggctgggtgggaacgtcaggagtggggcctgcctctttgctgggaatgccgtgcactcccagcccacttgccccatgccagcactcgaggcaggacttcgcagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagaggcaactacacagccagtggtgggaaagcacctaatttacatcttcatgcattgaaactgatgtcactcacctctcccccttgacctggaagagcccctgaaggctgccataggggaaatgataacccattctacagctgctgaaactgaggcccagggagtgtccagagctttctgaggtccaccatgtactgttgaccaggatgagtgatagccacctggtgacaatgttg

SEQ ID NO: 64 - DNA, 1305 bp, Homo sapiens
cctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagaaaaaaaaaaaaaaaaaaaaaaaaaaaaaaaaaaaaaaaa

SEQ ID NO: 65 - DNA, 7682 bp, Homo sapiens
gggccggggggcggagccttgcgggctggatctctctctgttgcccaagctggagtgcagtggcacagtcttggctcactgcaacctccacctcctgggtgcaagcgattctcgtgtctcagcctctcaagtagctgggattacaggttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcggggggttggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttatatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaagccagaagactcagcaaacaaggtagacagtgtctaccaccatagtggccataccaaagaggctaccgattccttcctgctacctggatccctgaagttgccctggtctctgcaccttctaaacctagttcttaagagctttccattacatgagctgtctcaaagccctccaataaattctcagtgtaagcttctgttgcttgtggacagaaaattctgacagacctaccctataagtgttactgtcaggataacatgagaacgcacaacagtaagtggtcactaagtgttagctacggttattttgcccaaggtagcatggctagttgatgccggttgatggggcttaaacccagctccctcatcttccaggcctctgtactccctattccactaaactacctctcaggtttatttttttaaattcttactctgcaagtacataggaccacatttacctgggaaaacaagaataaaggctgctctgcattttttagaaacttttttgaaagggagatgggaatgcctgcacccccaagtccagaccaacacaatggttaattgagatgaataataaaggaaagactgttctgggcttcccagaatagcttggtccttaaattgtggcacaaacaacctcctgtcagagccagcctcctgccaggaagaggggtaggagactagaggccgtgtgtgcagccttgccctgaaggctagggtgacaatttggaggctgtccaaacaccctggcctctagagctggcctgtctatttgaaatgccggctctgatgctaatcggcgaccctcaggcaagttacttaaccttacatgcctcagttttctcatctggaaaatgagaaccctaggtttagggttgttagaaaagttaaatgagttaagacaagtgcctgggacacagtagcctcttgtgtgtgtttatcattatgtcctcagcaggtcgtagaagcagcttctcaggtgtgaggctggcgcattatctggagtgggttgggttttctaggatggaccccctgctgcattttcctcattcatccaccagggcttaatggggaatcaaggaatccatgtgtaactgtataataactgtagccacactccaatgaccacctactagttgtccctggcactgcttatacatatgtccatcaaatcaatcctatgaagtagatactgtcttcattttatagatcagagacaattggggttcagagagctgatgtgattttcccagggtcacagagagtcccagattcaggcacaactcttgtattccaagacacaaccactacatgtccaaaggctgcccagagccaccgggcacggcaaattgtgacatatccctaaagaggctgagcacctggtcaggatctgatggctgacagtgtgtccagatgcagagctggagtgggggaggggaaggggggctccttgggacagagaaggctttctgtgctttctctgaagggagcagtctgaggaccaagggaacccggcaaacagcacctcaggtactccaggccctcctggctggagagggctgtggcaatggaaaattagtgccaactgcaatgagtcagcctcggttaaatagagagtgaagaatgctggacaggaacctccaccctcatgtcacatttcttcagtgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatctttcaactgaccctgatcaacgaagagggacttgtgtctctcagttggttccaaatgaaaccagggagcaggggcgttaggaagctccaacaggatggtacttaatggggcatttgagtggagaggtaggtgacatagtgctttggagcccagggagggaaaggttctgctgaagttgaattcaagactgttctttcatcacaaacttgagtttcctggacatttgtttgcagaaacaaccgtagggttttgccttaacctcgtgggtttattattacctcatagggactttgcctcctgacagcagtttatgggtgttcattgtggcacttgagttttcttgcatacttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactagatatatacataaaaaatgattgtattgcttcatttaaaaaatataacgcaaaatctcttttccttctaaaaaaaaaaaaaaaaaa

SEQ ID NO: 66 - DNA, 925 bp, Homo sapiens
ttttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatg

SEQ ID NO: 67 - DNA, 2704 bp, Homo sapiens
ccgaacaggattctttcacccaggcatctcctccagagggatccgccagcccgtccagcagcaccatgtgggtgaccaaactcctgccagccctgctgctgcagcatgtcctcctgcatctcctcctgctccccatcgccatcccctatgcagagggacaaaggaaaagaagaaatacaattcatgaattcaaaaaatcagcaaagactaccctaatcaaaatagatccagcactgaagataaaaaccaaaaaagtgaatactgcagaccaatgtgctaatagatgtactaggaataaaggacttccattcacttgcaaggcttttgtttttgataaagcaagaaaacaatgcctctggttccccttcaatagcatgtcaagtggagtgaaaaaagaatttggccatgaatttgacctctatgaaaacaaagactacattagaaactgcatcattggtaaaggacgcagctacaagggaacagtatctatcactaagagtggcatcaaatgtcagccctggagttccatgataccacacgaacacagctttttgccttcgagctatcggggtaaagacctacaggaaaactactgtcgaaatcctcgaggggaagaagggggaccctggtgtttcacaagcaatccagaggtacgctacgaagtctgtgacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagccgaggccatggtgctatactcttgaccctcacacccgctgggagtactgtgcaattaaaacatgcgctgacaatactatgaatgacactgatgttcctttggaaacaactgaatgcatccaaggtcaaggagaaggctacaggggcactgtcaataccatttggaatggaattccatgtcagcgttgggattctcagtatcctcacgagcatgacatgactcctgaaaatttcaagtgcaaggacctacgagaaaattactgccgaaatccagatgggtctgaatcaccctggtgttttaccactgatccaaacatccgagttggctactgctcccaaattccaaactgtgatatgtcacatggacaagattgttatcgtgggaatggcaaaaattatatgggcaacttatcccaaacaagatctggactaacatgttcaatgtgggacaagaacatggaagacttacatcgtcatatcttctgggaaccagatgcaagtaagctgaatgagaattactgccgaaatccagatgatgatgctcatggaccctggtgctacacgggaaatccactcattccttgggattattgccctatttctcgttgtgaaggtgataccacacctacaatagtcaatttagaccatcccgtaatatcttgtgccaaaacgaaacaattgcgagttgtaaatgggattccaacacgaacaaacataggatggatggttagtttgagatacagaaataaacatatctgcggaggatcattgataaaggagagttgggttcttactgcacgacagtgtttcccttctcgagacttgaaagattatgaagcttggcttggaattcatgatgtccacggaagaggagatgagaaatgcaaacaggttctcaatgtttcccagctggtatatggccctgaaggatcagatctggttttaatgaagcttgccaggcctgctgtcctggatgattttgttagtacgattgatttacctaattatggatgcacaattcctgaaaagaccagttgcagtgtttatggctggggctacactggattgatcaactatgatggcctattacgagtggcacatctctatataatgggaaatgagaaatgcagccagcatcatcgagggaaggtgactctgaatgagtctgaaatatgtgctggggctgaaaagattggatcaggaccatgtgagggggattatggtggcccacttgtttgtgagcaacataaaatgagaatggttcttggtgtcattgttcctggtcgtggatgtgccattccaaatcgtcctggtatttttgtccgagtagcatattatgcaaaatggatacacaaaattattttaacatataaggtaccacagtcatagctgaagtaagtgtgtctgaagcacccaccaatacaactgtcttttacatgaagatttcagagaatgtggaatttaaaatgtcacttacaacaatcctaagacaactactggagagtcatgtttgttgaaattctcattaatgtttatgggtgttttctgttgttttgtttgtcagtgttattttgtcaatgttgaagtgaattaaggtacatgcaagtgtaataacatatctcctgaagatacttgaatggattaaaaaaacacacaggtatatttgctggatgataaagatttcatgggaaaaaaaatcaattaatctgtctaagctgctttctgatgttggtttcttaataatgagtaaaccacaaattaaatgttattttaacctcaccaaaacaatttataccttgtgtccctaaattgtagccctatattaaattatattacatttc

SEQ ID NO: 68 - DNA, 4074 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggtttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttact

SEQ ID NO: 69 - DNA, 1795 bp, Homo sapiens
cgctgaggtgcgaaaactgggccaggggcagggctttgaccagctacttgagcgtgaaggggcggcgcccgcacgaaggggcgtcccagcttggaggcggggcccggatgggaggggcggggccgagtgcagtatcccgccagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttaaaaaaaaaaaaaaaaaa

SEQ ID NO: 70 - DNA, 2909 bp, Homo sapiens
gctgtcctggccgcgcccctgtcccgccgcctcccgctcctcgcctggcggatgtaggttgttggcctgaggggagctacgtagccgaggtttgcgctgccgccgccaggcccggtccggttccagcctctgcccggacgctagccggcctggccatggctgaccgcgggtgcccgctggaggcggcgccgctgcctgccgaggtgcgggagagcctggctgagctggagctggagctgtcggaaggtgacatcactcaaaaaggatatgaaaagaaaagggcaaagctgcttgcacgttatataccgcttattcaaggaatagacccatctctgcaagcagagaatagaattcctgggccctcacaaaccacggccgctgcacccaagcagcagaagtctcggcccaccgcctcgagggatgagcgcttccggtcagatgtccacactgaagccgtgcaagcagctttggccaaatacaaagagaggaagatgcctatgccttcgaagagacgttctgtccttgtgcattcgtctgtggaaacctacacccctccagacacgtcgtctgcctcagaagatgagggctctttacggcgacccgggcgactcacctccactccgctccagagccattccagcgtcgagccctggctcgaccgggtcattcagggctcgtccacctcatcctctgcatcctccacctcatctcacccgggagggagacccaccactgctcccagtgctgcagccacgccgggggccgccgctaccactgcactcgcaggcctcgaggcccacacccacatagatctgcattctgcccctcctgatgtcaccacgggcctcgtggagcattcgtactttgagcgtccacaggtggcttctgtgagaagtgttcctcgggggtgcagcgggagcatgctggaaacagcagatggtgtccctgtgaacagcagagtgtcctccaaaatccagcagcttctgaacaccctgaagaggccaaagcgccctccactgaaggagttctttgtggatgattttgaggaattgttggaagttcagcaaccagatccaaatcagccaaagcctgagggaagcgagacgagtgtgctgagaggggagcctctcactgcaggtgtcccccgaccgccgtcgctgttggccaccttgcagcgctggggcacaacacagcccaaatccccctgtctgactgccttggatacaactgggaaagccgtctacactctcacctatggtaaactttggagtcggagtttaaaactagcttatactctacttaataaactgacaagtaagaatgaacctctacttaaacctggagacagagtggcgctcgtgtttccgaatagtgaccctgtgatgttcatggttgcattttatgggtgtctcctggcagagctggttcctgtccccatagaagtgccattaacaagaaaggatgcaggcagccagcaggttgggtttctgctgggcagctgtggagtcttcttggccctgaccacagacgcttgtcagaaaggcctccccaaggcacagacaggagaggtggcagctttcaaaggttggcccccgctctcctggctagtgattgatgggaagcatctagccaagcccccaaaggactggcaccctctggcccaggacacagggactgggactgcctacattgagtataaaaccagcaaagaaggcagtacggtgggggtcacagtgtcccacgcatccctgctggcacagtgccgggctctgacccaggcgtgcgggtactcagaagctgaaacattaacaaacgtgctggatttcaaaagggatgctggtctgtggcatggcgtgttaacaagcgtcatgaacaggatgcacgtggtcagcgtcccctacgcgctgatgaaggcgaacccactctcctggatccagaaagtgtgcttctataaagctcgggccgcgctggtgaagtcgcgagacatgcactggtctctcctagctcagcggggccagagggacgtcagcctcagctcactgcgcatgctgattgtggccgatggtgccaacccgtggtcgatctcctcctgtgacgccttcctcaacgtcttccagtccagaggtctgaggccagaggtcatctgtccttgtgcaagttctcctgaggcgctgactgtcgccatccgcaggccacctgatctgggaggaccacctccaagaaaagcagtcctgtcgatgaacggtctaagttatggtgttatcagagtggatactgaagaaaagttgtcagtccttactgttcaggacgttggtcaggtgatgcctggagctaatgtatgtgttgtgaagttagaaggtaccccttatctttgtaaaactgatgaagtgggagaaatatgcgtcagttccagtgcaactggcacagcgtactatggattgcttggaatcacgaagaatgtgtttgaggcagttccggtcaccacaggaggagcacccatctttgacaggccattcaccaggacaggcctgctgggcttcatcgggcctgtgagtatgtcctcctgtaccagcactggcagtcagagaaggtagggggtgtggctaagggacacctcgttgcagccccacccttgtcctggccgttcctgacctcccatgtggccttggtcggtggcgctgacctccctgcccatcaccctacctgtgtgcagggccatccacacctccgagactggtgcacagtcctgcacacaggcctgagtcgggggtccccggggtggatgaggatgttttgctttttatatggagtggcaggtttgtgagtattcattatatcattctttaccattttggatgtctaaactattcaaaaataaatgcttctatttgtaaaaaaaaaaaaaaaaa

SEQ ID NO: 71 - DNA, 1929 bp, Homo sapiens
ctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttgaaaaaaaaaaaaaaaaaaaaaaaaaaaaaaaaaa

SEQ ID NO: 72 - DNA, 3312 bp, Homo sapiens
acagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcccgccttagcccccgcccccggccgcggccccgggccctgccccgcgcggccctgcccggcccaccgagccctggtgtggcagcggctcatggcggccgtggggcccccgcagcagcaggtgcggatggcccatcagcaggtctgggcggcgctcgaagtggcgctccgggtgccctgcctttacatcatcgacgccatcttcaactcctacccggattccagccaaagccggttctgcatcgtgctccagatcttcctccggctctttggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatacttta

SEQ ID NO: 73 - DNA, 3669 bp, Homo sapiens
aaaggtatcggtgctgtcgcttccggtccgggtaaacgaaccttaggtacactggtgtgtggcctcccaagataggcttctgagggcaagtcagcgactgaagacgggagcgccagaatctgtggactcaagagtctagaatcaagtggaaaaaccggaaaaaaggccaggaacctgaatacgacctaatagctgtttccgagggggcaacttccacggagaaccttctgccctggtaacggccaaagaggaggagatggcgccagtcagggagcggccgtggcccagacagtgaggaagcgcgaaggcggagcaaccgaggaatcctccggagaagaatcagagccgtcgctaccgccactaccgccaccaccatggaaggagcaaagccgacattgcagctcgtgtaccaggcagtgcaggcgctttaccacgacccagatcccagcggaaaggagcgcgcctctttttggcttggggagctgcagcgttcggttcatgcatgggagatctcagaccagttgttacagatccggcaggatgtggagtcatgctattttgctgcacagaccatgaaaatgaagattcagacctcattttatgagctccccacagactctcatgcctctttacgggactcattgctaacccatatccagaacttgaaagacttgtcacctgttattgtaacgcagctggctttagcaatagcagatcttgccctacagatgccttcctggaagggatgtgtgcaaacactggtggaaaaatacagcaatgatgtgacttctttgccttttttgctggagatccttacagtgttacctgaagaagtacatagtcgttccttacgaattggagctaatcggcgcacagaaattatagaagatttggccttctactctagtacagtagtatctctattgatgacctgtgtagaaaaagcaggaacagatgagaaaatgcttatgaaggtttttcgctgtttgggaagttggtttaacttgggagttttggacagtaacttcatggctaacaataaattactagcactcctttttgaggttttgcaacaggataagacctcgtctaacctacatgaagctgcttcggactgtgtatgctcagctctctatgccattgagaatgtggagactaacttgccattagccatgcaactttttcagggagtgctgacattggagactgcctatcatatggccgtggcacgtgaagatttagacaaagttctgaattactgccgtattttcactgaactatgtgaaacttttcttgaaaaaattgtttgtactccaggccaaggtcttggggaccttcgaactctggagctgctgcttatctgtgcaggccatcctcaatatgaggtagtagaaatttcatttaacttttggtaccgactgggggaacatttgtacaaaactaacgatgaagttattcatggcatcttcaaagcttacattcagaggctgcttcacgccttggctcgacactgccagctggaaccagaccatgagggggttcctgaggagactgatgactttggggagtttcgcatgagggtatcagacctggtaaaggacttgattttcttgatagggtctatggagtgttttgctcagttatattctactctgaaagaaggcaacccaccctgggaggtgacagaagcggttctctttatcatggctgctatagcaaagagtgttgatccggaaaacaatccaacacttgtggaagtcctagaaggagttgtccgcctcccggagaccgtacatacggctgtgcgatacaccagcattgaattggttggagagatgagtgaagtcgttgatcgaaatcctcagttccttgaccctgtgttgggctatttgatgaaaggcctgtgtgaaaagcccctggcttctgctgcagccaaagccattcataacatttgctctgtctgccgagatcacatggctcagcactttaatggactcctggagattgcccgctccctcgattccttcctgttgtctccagaagctgctgtgggcttgctaaaagggacagcacttgtcctagcccgattacctttggataagattaccgaatgtcttagtgaactatgttctgttcaggttatggcattgaaaaagctgttgtctcaagagcccagcaatggcatatcctcagatcccacagtgttcttagatcgccttgcagtgatatttaggcataccaatcccattgtggaaaatggacagactcatccgtgtcagaaagtcatacaggaaatatggccagttttatccgagactctaaataagcaccgagctgataatcggattgtagagcgttgttgcaggtgcctgcgctttgctgttcgctgtgtaggcaaaggatctgcagcactgctgcagccactagtcacacagatggtgaatgtgtaccacgtacatcagcattcctgcttcctgtaccttggcagtatccttgtggatgaatatggcatggaagaaggctgtcggcagggactgctagacatgctccaggcactgtgcatccccacctttcagctcctagaacagcagaatggtctccagaatcaccctgacactgtagatgacctgttccggctagccaccaggtttattcagcgtagccctgtcaccttgctgcggagccaagtggtcatccctatcttacagtgggccattgcctctactaccctggaccaccgggatgccaattgtagtgtcatgaggtttctacgagacctcattcatacaggggtagccaatgatcatgaagaagactttgaattacggaaagaactgattggacaggtgatgaaccagcttggacagcagcttgtcagccagctgctgcacacctgctgcttttgcctccccccctataccctaccagatgtggctgaagtgctctgggagatcatgcaggttgacagaccgactttttgtcgatggttagaaaattccttaaaaggtttgccaaaggaaacaaccgtgggagccgtcacagtgacacacaaacaacttacagacttccacaagcaagtcactagtgctgaggaatgtaaacaagtttgctgggccttgcgagacttcaccaggttgtttcgatagctcacactcctgcactgtgcctgtcacccaggaatgtcttttttaattagaagacaggaagaaaacaaaaaccagactgtgtcccacaatcagaaacctccgttgtggcagaggggccttcaccgccaccagggtgtcccgccagacagggagagactccagccttctgaggccatcctgaggagttcctgtttgggggtgtgagggaaaatcagcgcggattttaaaaagatggctgtggcctgcccggcgtggtgggaggggagctggtttcctggtgaactttctaaaaggaaaaataattttaagtaaagaaaaaagaaaaaaaaggaagactaaacagaaaccagaactgaaacattcacctggtagcaaatgacacatgcacgcacacacacatacacgcacaagcgccagtgcgcacgtgtacacagaaaaacaaaaggacaagctttctgtgaaacaaaatatttacttagggataatgtggggattcacatgaattaaatagctgcaattggaa

SEQ ID NO: 74 - DNA, 5840 bp, Homo sapiens
gcgcggcctcagagggtcgggcggacgccgcctggtgagaagcaggcagccagtacccttgccacggtagaatgggtgaggaggggccccccagcctggagtacatccaagccaaggatctgttcccccccaaggaactagtgaaggaggaagagaatcttcaggtccccttcacagtgctgcagggtgagggagtagagttcctgggccgggcagccgatgccctcattgccatctctaactaccggctgcatatcaaattcaaggactctgtcatcaacgtccccctccggatgattgacagtgtggagagccgtgatatgttccagttgcacatttcctgcaaggactccaaagtggtgaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacctgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccggcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagtaaaaaaaaaaaaaaaaaaaaaaaaaaaaaaaaaaaaaaaaaaaaaaaaaaaaaaa

SEQ ID NO: 75 - DNA, 5138 bp, Homo sapiens
gatccgcagaggagcccacttgagagcgcctcctgtcgtctgtaaggttgccttgccatccctcggcaccccaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcaaaaa

SEQ ID NO: 76 - DNA, 1603 bp, Homo sapiens
gaattgcggccgtatgcgcggctctgtggagtgcacctggggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttctgcccttgtttttaccaggctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccagttggaccagctactgtggggctccctcccatcaggctttgcacagtggcgaccagtggcttactcccagaagccggggggccgagaatcagccctgccctgccaagcttcccctcttcatcctgccttagcatactctcttccccagtcacccattgtccgagccttctttgggtcccagaataacttctgtgccttcaatctgacgttcggggcttccacaggccctggctattgggaccaacactacctcagctggtcgatgctcctgggtgtgggcttccctccagtggacggcttgtccccactagtcctgggcatcatggcagtggccctgggtgccccagggctcatgctgctagggggcggcttggttctgctgctgcaccacaagaagtactcagagtaccagtccataaattaaggcccgctctctggagggaaggacattactgaacctgtcttgctgtgcctcgaaactctggaggttggagcatcaagttccagccggccccttcactcccccatcttgcttttctgtggaacctcagaggccagcctcgacttcctggagacccccaggtggggcttccttcatactttgttgggggactttggaggcgggcaggggacagggctattgataaggtccccttggtgttgccttcttgcatctccacacatttcccttggatgggacttgcaggcctaaatgagaggcattctgactggttggctgccctggaaggcaagaaaatagatttattttttttcaaaaaaaaaaaaaaaaaaa

SEQ ID NO: 77 - DNA, 4176 bp, Homo sapiens
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcgagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgataaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggctagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgccttagcaaattctgtttttctaggcctggggacggcttttacttaaaccgccaaggctgggggaagaagctctctcctccctttcttccctacagttgaaaaacagctgagggtgagtgggtgaataatacagtatctcagggcctggtcgttttcaacagaattataattagttcctcattagcattttgctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgtgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctgggtgacagagcaagtgagaccctgtctcaaaaaaagaaaaagaaaaagaaaaaatattttccctattagagaagagattgtggtttcattctgtattttgtttttgtcttaaaaagtggaaaaatagcctgcctcttctctactctagggaaaaaccagcgtgtgactactcccccaggtggttatggagagggtgtccggtccctgtcccagtgccgagaaggaagcctcccacgactgcccggcagggtcctagaaattccccaccctgaaagccctgagctttctgctatcaaagaggttttaaaaaaatcccatttaaaaaaaatcccttacctcggtgccttcctctttttatttagttccttgagttgattcagctctgcaagaattgaagcaggactaaatgtctagttgtaacaccatgattaaccacttcagctgacttttctgtccgagctttgaaaattcagtggtgttagtggttacccagttagctctcaagttatcagggtattccagagtggggatatgatttaaatcagccgtgtaaccatggacccaatatttaccagaccacaaaacttttctaatactctaccctcttagaaaaaccaccaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaaaaaggcaggatggccgggcgcggtggctcacgcctgtaatcctagcactttgggaggccaaggtgggaggattgcttgagctcaggagtttgagaccaacctggg

SEQ ID NO: 78 - DNA, 4577 bp, Homo sapiens
tccgtgaggcgcgggcggcggcgaccgcggcgccagtgagggggccctggggcccgggcggctccgggccggggccccgccgcgggacggaccatgctacgctccactggcttcttccgggccattgactgcccctattggtctggggcgcccggggggccctgccggcggccctactgccacttccggcaccgcggggcccggggccccggcgcgcccggtgacggcggagaggcgccccccgcagcagggctgggttacgacccctacaaccctgagctgcccaagccccccgcgcagagggagaatggcaccctgggcctgggggaggagccgcgcccggatgtgctggagttggagctggtcaaccaggccatcgaggccgtgcgcagtgaggtggagctggagcagcggcgctaccgggagctgctggagacgacccgtgagcaccgctccgccgaggcccccgccctggcgccccgcggccccaacgccagccccactgtgggcccggacgaggatgccttcccactggccttcgactacagccccggcagccacggcctattaagccctgatgccggctaccagcccaccccactggccgcccctgccgagccgggcagcaagtactcgctggcgtccctggacaggggtcagggcagaggtggagggggtggcggtgccctggaatacgtccccaaggctgtgagccagccccggcggcacagccgccccgttcccagtggcaagtacgtggtggacaactccaggccacccacagacctggagtatgaccctctctccaactactcggcccggcacctcagcagggccagctcccgggatgagcgggccgccaagcggccccggggctcccgcggcagtgagccctacacacctgctcccaagaagctctgtgacccctttggcagttgcgatgcaaggttctcagactcagaagatgaggccgccacggtcccaggtaacgagcccaccacggccagcacccccaaagccagggccgaccctgagatcaaggccaccgggcagccaccctccaaagagggcctggaggccgaggggggcggcctgcgggagaccaaggagacggccgtgcagtgcgacgtgggggacctccagccgcccccagccaagcccgcctccccagcccaggtccagtcctcacaggatgggggctgccccaaggagggaaaacccaagaagaaaaaaaccggggccccacctgcccccagctgcaaagacggggcccaggggaaggacaagaccaaggacaagggccgagggcggcctgtggagaagccccgtgcggacaagaagggcccgcaggccagcagcccccggcgcaaggcagagcggccggaagggaccaagaagaagccatcttcggccactcctgtggccacctcagggaaagggaggcctgaccggccagcgcggcggccgagccccacaagcggggactcccgaccggcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcagccccccaaggaagagaagagtgaggagaaggggctttcgggtctgaccactctgttccccgggcagaagaggaggatctcccacctttccaagcaaggccaggaggtggagcccccgaggaggggtcccgcggtgcccccggcccggcccccgacggcgcaggaggtgtgctacctgcgggcccagcaggcgcagagggcatcggcgagcttgctgcaggcccccgccaggctggcagagaagtcgccctccgtccacatttccgcccctggcgagaagaggaggatcgcccacatccccaacccccgcctggctgcagcccccacaggtgccaagaggacccttgcggccagcggcagccagccctccaacggccctgagccaggtggccagcagctgaaaacacgcacattgtcggggatggcgtccaagactaccaccaccatcatccctaagcgaatcgcccacagtccatccttacagagtttaaagaaacccattatccccaaagagtttgggggcaaagtccccaccgtcatccgccagcgctatctcaacctgttcatcgaggagtgtctcaagttctgtacctccaaccaggaggccatagagaaggcactgaacgaggagaaggtggcctatgaccgcagccccagcaagaacatctacctgaatgtggccgtgaacaccctcaagaagctcaggggcctggcccccagcgctgtgcccggcctcagcaaaaccagtggccgcagggttgtgtcccacgaggtggtgttggggggcaggttggccgccaagaccagcttctcgctcagccgtccaagcagcccccgggtggaggacctgaaaggggctgccctgtacagccgcctcagggagtacctgctcacccaggaccagctcaaggagaacggctaccccttcccgcacccagagcggcccgggggcgcaatcatcttcacagctgaggagaagaggcccaaggactcttcctgcaggacctgctgccgctgtggcaccgagtacctcgtgtcctcttcaggccgctgcatccgggacgaggagtgttattaccactggggacggctgcgccggaaccgggtggccggaggctgggagacccagtacatgtgctgctcggctgccgccggctctgtcggctgccaagtcgcaaagcaacacgtgcaggatggccggaaggagcgccttgagggcttcgtgaagacctttgagaaagagctctcaggagacacccacccggggatctacgccctggactgcgagatgtcctacaccacatatggcctggagctgacgcgcgtcacggtggtcgacacggacgtgcacgtggtttatgacaccttcgtgaagcctgacaacgagatcgtggactacaacaccaggttttcgggggtgacggaggctgaccttgccgacacaagtgtcacgctgcgtgacgtccaggccgttctgctgagcatgttcagcgctgacaccatcctcatcggacacagcctggagagcgacctcctggccctgaaggtcatccacagcaccgtggtggacacgtctgtgctcttcccccaccgcctgggcctcccctacaagcggtccctgcggaacctcatggccgactacctcagacagatcatccaggacaatgtggatgggcacagctccagcgaggacgccggcgcctgcatgcacctggtgatctggaaggttcgagaagacgccaagaccaagcgatgacgcctgcccgcctcccacccgcctctcctgccgtcccgctggtccttagccccatgcctcttccaaaacagtgcaataaatctccggtaacccgtccacctggccgaggcagcccagagcagcgggatgagctggcggccagagaacgcccagcccagcccacccccgctcacgtcctgccgcacccctccgccggtccccaccctctgccccccagccctctggcgtctctagaaactgctgctgatggagaccaggacagagcccgcccccacccggcccgcagcccctcctgcccctcctgccaggccctccctcccgggtggtggccggcacctctgctcctcacgtgggtcgcggggcgggcttgtcccaggtttgtttgagacagtctttttttattttgtattgttatttttattatttttaatttaaacctgatgacttgcacagcatctttcccaccgggaagagcgggcctgctgccttccctcctgcggggtgggggtgggacagaccccagtgggggccagggccacactcagcgcagtgtgggctggacccgcctctgtgctccaggggctggccggtcttcgggggcgccggcttccaccactcgccgccccacccctgcactccgtgacctctgagaacccagctggcccctcgttagccccagggtctgccgtctagagggagcccaccggcctccggacactgtcttcccgctagagccccgtcctcctctgcggggctctccggacccccttccccctcacctccaggcagggacagaataaatgtttgtatggatttta

SEQ ID NO: 79 - DNA, 5463 bp, Homo sapiens
gaagcggtggccgccgagcgggatctgtgcggggagccggaaatggttgtggactacgtctgtgcggctgcgtggggctcggccgcgcggactgaaggagactgaaggccctcggatgcccagaacctgtaggccgcaccgtggacttgttcttaatcgagggggtgctggggggaccctgatgtggcaccaaatgaaatgaacaaagctccacagtccacaggccccccacccgccccatcccccggactcccacagccagcgtttcccccggggcagacagcgccggtggtgttcagtacgccacaagcgacacaaatgaacacgccttctcagccccgccagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggggcgttccacatacgttgtcccgacacagcagtaccctgtgcagccaggagccccaggcttctatccaggtgcaagccctacagaatttgggacctacgctggcgcctactatccagcccaaggggtgcagcagtttcccactggcgtggcccccgccccagttttgatgaaccagccaccccagattgctcccaagagggagcgtaagacgatccgaattcgagatccaaaccaaggaggaaaggatatcacagaggagatcatgtctggggcccgcactgcctccacacccacccctccccagacgggaggcggtctggagcctcaagctaatggggagacgccccaggttgctgtcattgtccggccagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaagtggcagtatctgtgccaaagaggagacggaaaattaaggagctaaataagaaggaggctgttggagaccttctggatgccttcaaggaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcagatcagtggaagcctctaaacctagaggagaaaaaacgttacgaccgtgagttcctgcttggttttcagttcatctttgccagtatgcagaagccagagggattgccacatatcagtgacgtggtgctggacaaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcgctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaagccccgaatggatcagtatttcaaccagatggaaaaaatcattaaagaaaagaagacgtcatcccgcatccgctttatgctgcaggacgtgctggatctgcgagggagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagccgtggacttccccttgtggatgatggtggctggaacacagttcccatcagcaaaggtagccgccccattgacacctcacgactcaccaagatcaccaagcctggctccatcgattctaacaaccagctctttgcacctggagggcgactgagctggggcaagggcagcagcggaggctcaggagccaagccctcagacgcagcatcagaagctgctcgcccagctactagtactttgaatcgcttctcagcccttcaacaagcggtacccacagaaagcacagataatagacgtgtggtgcagaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccgtgaagcgagaagctgccctacccccagtgagccccctgaaggcggctctctctgaggaggagttagagaagaaatccaaggctatcattgaggaatatctccatctcaatgacatgaaagaggcagtccagtgcgtgcaggagctggcctcaccctccttgctcttcatctttgtacggcatggtgtcgagtctacgctggagcgcagtgccattgctcgtgagcatatggggcagctgctgcaccagctgctctgtgctgggcatctgtctactgctcagtactaccaagggttgtatgaaatcttggaattggctgaggacatggaaattgacatcccccacgtgtggctctacctagcggaactggtaacacccattctgcaggaaggtggggtgcccatgggggagctgttcagggagattacaaagcctctgagaccgttgggcaaagctgcttccctgttgctggagatcctgggcctcctgtgcaaaagcatgggtcctaaaaaggtggggacgctgtggcgagaagccgggcttagctggaaggaatttctacctgaaggccaggacattggtgcattcgtcgctgaacagaaggtggagtataccctgggagaggagtcggaagcccctggccagagggcactcccctccgaggagctgaacaggcagctggagaagctgctgaaggagggcagcagtaaccagcgggtgttcgactggatagaggccaacctgagtgagcagcagatagtatccaacacgttagttcgagccctcatgacggctgtctgctattctgcaattatttttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccaacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcaaaaaaaaaaaaaaaa

SEQ ID NO: 80 - DNA, 885 bp, Homo sapiens
ggagcatgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccggcttgaaaagagattatgactgtaccttttaactttgtagctggaacacaagaagtgtttgtttaatgaatgacgtacacatttaagatctgtttggacgcggaggataatcctgtgaattgctaatagttcactgggtttggcccttagtgttgacttcagtatgctgagacggaaaccaacacgcctagagctaaagcttgatgacattgaagagtttgagaacattcgaaaggacctggagacccgtaagaaacagaaggaagatgtggaagttgtaggaggcagtgatggagaaggagccattgggcttagcagtgatcccaagagccgggaacaaatgatcaatgatcggattggttataaaccccaacccaagcccaataatcgttcatctcaatttggaagtcttgaattttagagatggattatcttgcatgccagagcgctggaatggaataaaatgatggcagaagtacaaaccagatttagagaattgagtgcttgcagtcaagcagaatgtacctcctgcagagacaaatcttctgcatgagattactgatgcttcacttgcactctaagctggaatccaaactctggtttgtctcttgaaaatttgactctataaaactgatctgattttctgtttttaaaaataaatatatttttggaaaaaaaaaaaaaaaaaa

SEQ ID NO: 81 - DNA, 1515 bp, Homo sapiens
tcgcgcctcgctctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaa

SEQ ID NO: 82 - DNA, 3011 bp, Homo sapiens
ggcacgagccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtgaaaaaaaaaaaaaaaaaaaaaaaaaaaaaaaaaaaaaa

SEQ ID NO: 83 - DNA, 3320 bp, Homo sapiens
gtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctgcggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctccactcacacatgtagacaaacattagctctttactctttctcaaccccttatatgattttaataattctcacttcactaattttgtaagcctgagatcaataagaaatgttcaggagagaggaaagaaaaaatatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaaatgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcaaaaa

SEQ ID NO: 84 - DNA, 1184 bp, Homo sapiens
ggcgctgcgggggctgacatgtcgtcccggcctgggcgcgaggacgtgggggctgcgggcgcgcggcggccgcgtgagccgccggagcaggagctgcagcgacgtcgggagcagaagcggcggcgacacgacgcgcagcagctgcagcagctcaagcacctggagtccttttacgaaaaacctcctcctgggcttatcaaggaagatgagactaagccagaagattgcataccagatgtaccaggcaatgaacacgccagggaatttctggctcatgcaccaactaaaggactttggatgccactggggaaagaagtcaaagttatgcagtgttggcgttgcaaacgctatggtcaccgaacgggtgacaaagaatgccctttctttatcaaaggcaaccaaaagttagagcagttcagagtggcacatgaagatcccatgtatgacatcatacgagacaataaacgacatgaaaaggacgtaaggatacagcagttaaaacagttactggaggattctacctcagatgaagataggagcagctccagttcctctgaaggtaaagagaaacacaagaaaaagaagaagaaagaaaagcataagaaaaggaagaaagaaaagaaaaagaagaaaaaacggaagcacaaatcttccaagtcaaatgagggttctgactcagagtgacaaggatgtgacttgttcaacattctcttctcaaacactgaccaaggaacagaggaagatgcagtcagagaaagcagcaggatagagacgccgagagaggagtatatgtgggtcacagcagtgagctcccacccgccttgcagtgaagatgtgaccccaggagagggagtgtctccttccaggtgctagctctggacagcagctgattttaggcaggaaagtttcttcatcgttgtcctccctgctggtcacatgagtttacgattcctttgaagtgtctcccacagggtggcaggactgggagaatctctgaggcgtgtcttccaggccctcccacagcttgtgccctccacagtgtggactcaggtcccatagacatcaggctggagtcttctctgttgttgagaataataaaagctcattatttattttttaaaaaaaaaaaaaaaaaaaaaaaaaaaaaaaaaaaaaaaaaaaaaaaaaaaaaaaaaaaaaaaaaa

SEQ ID NO: 85 - DNA, 978 bp, Homo sapiens
ccgcgtcggtgcccgcgcccctccccgggccccgccatgggcctcaccgtgtccgcgctcttttcgcggatcttcgggaagaagcagatgcggattctcatggttggcttggatgcggctggcaagaccacaatcctgtacaaactgaagttgggggagattgtcaccaccatcccaaccataggcttcaatgtagaaacagtggaatataagaacatctgtttcacagtctgggacgtgggaggccaggacaagattcggcctctgtggcggcactacttccagaacactcagggcctcatctttgtggtggacagtaatgaccgggagcgggtccaagaatctgctgatgaactccagaagatgctgcaggaggacgagctgcgggatgcagtgctgctggtatttgccaacaagcaggacatgcccaacgccatgcccgtgagcgagctgactgacaagctggggctacagcacttacgcagccgcacgtggtatgtccaggccacctgtgccacccaaggcacaggtctgtacgatggtctggactggctgtcccacgagctgtcaaagcgctaaccagccaggggcaggcccctgatgcccggaagctcctgcgtgcatccccgggatgaccagactcccggactcctcaggcagtgccctttcctcccacttttcctcccccatagccacaggcctctgctcctgctcctgcctgcatgttctctctgttgttggagcctggagccttgctctctgggcacagaggggtccactctcctgcctgctgggacctatggaaggggcttcctggccaaggccccctcttccagaggaggagcagggatctgggtttccttttttttttctgttttgggtgtactctaggggccaggttgggagggggaaggtgagggcttcgggtggtgctataatgtggcactggatcttgagtaataaatttgctgtggtttg

SEQ ID NO: 86 - DNA, 3923 bp, Homo sapiens
ctctctgaggctgcgccaagacctgaagcggcggaccgagagcccgggtctgagactgagagagcaacggaatggaggcggggtagaggcggaaacacaacctgcagggccagagcgaggcgcgagaaggacggcggcgtgagggggcggggcgcgcagcgcgagaaggcaggcacgaggggcgagcgcgaggcggggcacggcgcgtggcgtgagacggggcggggcgcgcgtatcggcgccgcggccgcgtgacgcgttttcaaatcttcaaccgccgcagcccactcgtttgtgctttgcgccttcctcctccgcgccttggagccggatccggccccggaaacccgacctgcagacgcggtacctctactgcgtagaggccgtagctggcggaaggagagaggcggccgtcctgtcaacaggccgggggaagccgtgctttcgcggctgcccggtgcgacactttctccggacccagcatgtaggtgccgggcgactgccatgaactccggagccatgaggatccacagtaaaggacatttccagggtggaatccaagtcaaaaatgaaaaaaacagaccatctctgaaatctctgaaaactgataacaggccagaaaaatccaaatgtaagccactttggggaaaagtattttaccttgacttaccttctgtcaccatatctgaaaaacttcaaaaggacattaaggatctgggagggcgagttgaagaatttctcagcaaagatatcagttatcttatttcaaataagaaggaagctaaatttgcacaaaccttgggtcgaatttctcctgtaccaagtccagaatctgcatatactgcagaaaccacttcacctcatcccagccatgatggaagttcatttaagtcaccagacacagtgtgtttaagcagaggaaaattattagttgaaaaagctatcaaggaccatgattttattccttcaaatagtatattatcaaatgccttgtcatggggagtaaaaattcttcatattgatgacattagatactacattgaacaaaagaaaaaagagttgtatttactcaagaaatcaagtacttcagtaagagatgggggcaaaagagttggtagtggtgcacaaaaaacaagaacaggaagactcaaaaagccttttgtaaaggtggaagatatgagccaactttataggccattttatcttcagctgaccaatatgccttttataaattattctattcagaagccctgcagtccatttgatgtagacaagccatctagtatgcaaaagcaaactcaggttaaactaagaatccaaacagatggcgataagtatggtggaacctcaattcaactccagttgaaagagaagaagaaaaaaggatattgtgaatgttgcttgcagaaatatgaagatctagaaactcaccttctaagtgagcaacacagaaactttgcacagagtaaccagtatcaagttgttgatgatattgtatctaagttagtttttgactttgtggaatatgaaaaggacacacctaaaaagaaaagaataaaatacagtgttggatccctttctcctgtttctgcaagtgtcctgaaaaagactgaacaaaaggaaaaagtggaattgcaacatatttctcagaaagattgccaggaagatgatacaacagtgaaggagcagaatttcctgtataaagagacccaggaaactgaaaaaaagctcctgtttatttcagagcccatcccccacccttcaaatgaattgagagggcttaatgagaaaatgagtaataaatgttccatgttaagtacagctgaagatgacataagacagaattttacacagctacctctacataaaaacaaacaggaatgcattcttgacatttccgaacacacattaagtgaaaatgacttagaagaactaagggtagatcactataaatgtaacatacaggcatctgtacatgtttctgatttcagtacagataatagtggatctcaaccaaaacagaagtcagatactgtgctttttccagcaaaggatctcaaggaaaaggaccttcattcaatatttactcatgattctggtctgataacaataaacagttcacaagagcacctaactgttcaggcaaaggctccattccatactcctcctgaggaacccaatgaatgtgacttcaagaatatggatagtttaccttctggtaaaatacatcgaaaagtgaaaataatattaggacgaaatagaaaagaaaatctggaaccaaatgctgaatttgataaaagaactgaatttattacacaagaagaaaacagaatttgtagttcaccggtacagtctttactagacttgtttcagactagtgaagagaaatcagaatttttgggtttcacaagctacacagaaaagagtggtatatgcaatgttttagatatttgggaagaggaaaattcagataatctgttaacagcgtttttctcgtccccttcaacttctacatttactggcttttagaatttaaaaaatgcatacttttcagaagtgataaggatcatattcttgaaatttttataaatatgtatggaaattcttaggatttttttaccagctttgtttacagacccaaatgtaaatattaaaaataaatatttgcaattttctacagaattgaatacctgttaaagaaaaattacagaataaacttgtgactggtcttgttttacattatatatatgttcgtaattgtttcctgagaattacaatgaataataatttgctttgtcactgaaaaccaccagtgaagtgcaatttggggaatatcaaacttagcattatacatttggatattctagttgtattgtaaattttaaaagattatcaggataacatgaccttgccttgaaaaacctaaatttcatacagaaaggaaaaatacatttctatgcttgaattctggaaatcatcagaaatattgacacttgagggtcactggtggaccatgctagtattttggtgctgagtaattagattatgtataggggtaactggaagccatgaaggaaggacttaaccaggctaccaagtggaatataatttatctgctatttttaattacttaccttgtaaataactttaataatattcaaaagttgactctcctgtggctcatgccacaggatcccagcactttgggaggccgaggcaggctgatcacgaggtcagaagatcaagaccatcctggccaacatggtgaaaccttgtctactaaaaatacaaaaaattagctgggcatggcggcatgcgcctgtagtcccagctactccctccagaggctgagaattgcttgaacctgggaagtgcaggttgcagtgagccaagattgtgccactgtattccagactgggtgacagagtgagactccatctcaaaaaaaaaaaagttgactctaccccctaatttggtaggagatgaaggagaaaaggatggcattgaattatagatacagttttgggatatatacaaggattgccttgatctggcacttactgatacaagcatttggagaagagaaaattcaaatataagaaatttcaatttgaatctgtggatataaggcatttgcctttgagtatgttcttgtaggagtaagactaccaccagtgacattcaattggttctattgcatagtacatgaatctattgtcactaaaaattaggttactaatcttaatttttttgaaatatatgattctcagtacaggactaattcatatgcttttcctgcatacattattttgatcatttggataacatcaatgaacactggctttttaacacctttgtttttcataccagtacctgaagtaggctcaataaaagagtctttacagtgaaaaaaaaaaaaaaaa

SEQ ID NO: 87 - DNA, 819 bp, Homo sapiens
acctaggactccctgagctgggactagcgaaatctgtctgcactgatcgcagtcgtcctcagtttcaccctctaggaatcggcctggggatgcacgtgctactctcttcctccaggccggtccccggcgcgtgcgcgcgatccatgtccatgtccgcgcctatcaataaagttgctcacttgttgccggcccgctagcccgaaaggttgcgcgcgcagaccgagaagtctcgcgatagccagccgcggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaactacttcctcggtggctgcgccggaggcctgactctgggagcacgcacgcacaactacgggattggcgccgccgcctgcgtgtactttggcatagcggcctccctggtcaagatgggccggctggagggctgggaggtgtttgcaaaacccaaggtgtgagccctgtgcctgccgggacctccagcctgcagaatgcgtccagaaataaattctgtgtctgtgtgtgaaaaaaaaaaaaaaaaaaaa

SEQ ID NO: 88 - DNA, 3194 bp, Homo sapiens
cgctgccgcttcctgggctgagtccgcccgcggtcccggcggcgccaggtgcgttcactctgcccggctccagccagcgtccgccgccgccgtagctgccccaggctccccgccccgctgccgagatggcgacgcgctcctgtcgggagaaggctcagaagctgaacgagcagcaccagctcatcctatccaagcttctgagggaggaggacaacaagtactgcgccgactgcgaggccaaaggtcctcgatgggcttcctggaatattggtgtgtttatttgcatcagatgtgctggaattcatagaaatcttggggttcatatatccagggtcaaatcagtcaacctagaccaatggacagcagaacagatacagtgcatgcaagatatgggaaatactaaagcaagactactctatgaagccaatcttccagagaactttcgaagaccacagacagatcaagcagtggaatttttcatcagagataaatatgaaaagaagaaatactacgataaaaatgccatagctattacaaataaagaaaaggaaaaaaaaaaggaagagaaaaagagagaaaaggagccagaaaagccggcaaaaccacttacagctgaaaagctgcagaagaaagatcagcaactggagcctaaaaaaagtaccagccctaaaaaagctgcggagcccactgtggatcttttaggacttgatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatgaaaactgcaatacaagtttcatccagaactaccacctgacattccttgctgaaacgcatctagttcccctgtttattcatatgcatattttttttctttttacccatttgttcatattaagaatgatctgattgaccgtgttggtctgtactgattcaatttgatgtggtgaaaagcaggttgataaatcattttatgtcaagggcagctttgctcatatttcccatgatttcatgtactgcattatttgagaagctgctcaacttgcaaaatcagttttcctctcaataaaattatagctctaatgtttgcatataagggaagtagttatcatgttagtaatacctctaatagtataaaccccaccccaaaattagccagtaatcctgtaggaaggtactgtatgatcaaatgtttaatcatataaatagaatgtaaatgtctcactgagcactgttttctagtgtatcaaaatgctcttatttcatcattcacttcactgtgctgttgttatgatgtgcttaacagggaacgtgattagtgaaaggaagataaacgtggatgttactccaaaacttcgtttaatgaatgcttaaagaattcaaattttatctgcctctcttgtaatttggatctcttcttaatgtacatagtgctaacatgaagacctttttctgcactatatgcaaacagggtaactaactaaaacaaagccactttcaatcttcaatccttgaaggtatatctaggtttatgacagtaattgtgtttacattttatggtgcctagtattgacaaaatgttatttccctacattaaacatgactccatagaccttttcatttgtgggtttttatttcctatgatgtatactgccactaaccttccaaaaattacttagtattgcaaagtcaggaatcatcaggaacgtttagctgacaaaatacttgtctgttttaaaaacctgttcaagtctaccaacctgttcaagtctaccaattataagggcaaattggagaaaaagaaaaaatatatactcaagagtggtatcttgcagtatcggcactgtacaaaaaaatcttccaatttagttgttgtagagaaaacatgcagaacaaatgaagacaaaacatacattttgtaccaaccatccaattagcttatggtaactgacaagctccatttaaacagatgtccatcagatgacaagaaaggctgctgtactgaagtaaaacaaacaatacctgaatgctctgtagcctaaactccaaacatcctcttccatatggatccactggctggacaaactgcaccagttgctgcttcaatttatacctcaattttcactgtgtccaggtggtactttggctcgttggctagattaaccttctctgtccgagtgtgccacacgagaacctgaaggggaaggaaatagcttgggtagcgcactcttcatggtgacactcgaggtcgggcagcacaagtgtaatgaataccttagtgcagttatttgctttcggttccagttcttcgactgttgttatctgtttgagaaagtcagattcttgcatccctggctgggatccacgacgcttaaatacagcttttggattggacaaaatgacttgaagacttacagcaaatcctttgtgaaaaataaaaaaaaaaaaagagactttaaaaaaaaaaaaaaaaaaaaaaaaaaaaaaaaaaaaaaaaaaaaaaaaaaaaaaaaaaaaaaaaaaaa

SEQ ID NO: 89 - DNA, 3033 bp, Homo sapiens
gaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcagatttggaggccaatcactgccaccttttatttccctgtgggtccaggaactggatttctttatttggtcaatttatatttcttatatcagtattctacgcgacttgaaacaggagcttttgatgggaggccagcagactatttattcatgctcctctttaactggatttgcatcgtgattactggcttagcaatggatatgcagttgctgatgattcctctgatcatgtcagtactttatgtctgggcccagctgaacagagacatgattgtatcattttggtttggaacacgatttaaggcctgctatttaccctgggttatccttggattcaactatatcatcggaggctcggtaatcaatgagcttattggaaatctggttggacatctttattttttcctaatgttcagatacccaatggacttgggaggaagaaattttctatccacacctcagtttttgtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctaatctgctggcattgagctggggctgggtcaccaaacccttcccaaaaggaccttatctctttcttgcacacatgcctctctcccacttttcccaacccccacatttgcaactagaaaaagttgcccataaaattgctctgcccttgacaggttctgttatttattgacttttgccaaggctggtcacaacaatcatattcacgttattttccccttttggtggcagaactgttaccaatagggggagaagacagccacggatgaagcgtttctcagcttttggaattgcttcgactgacatccgttgttaaccgtttgccactcttcagatattttttataaaaaaagtaccactgagttcatgagggccacagattggttattaatgagatacgagggttggtgctgggtgtttgtttcctgagctaagtgatcaagactgtagtggagttgcagctaacatgggttaggtttaaaccatgggggatgcacccctttgcgtttcatatgtagccctactggctttgtgtagctggagtagttgggttgctttgtgttaggaggatccagatcatgttggctacagggagatgctctctttgagaggtcctgggcattgattcccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacttctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatatttctgacagtgagtgacccggagtctctggtgtaccctcttaccagtcagctgcctgcgagcagtcattttttcctaaaggtttacaagtatttagaacttttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttg

SEQ ID NO: 90 - DNA, 360 bp, Homo sapiens
ggccgctgtcgccgccgcggagacaaagatggctgcgagagtcggcgccttcctcaagaatgcctgggacaaggagccagtgctggtcgtgtccttcgtcgtcgggggcctcgctgtaattctgcccccattgagcccctacttcaagtactccgtcatgatcaacaaggccacgccctacaactacccagtgcccgtccgtgatgatgggaacatgcccgacgtgcccagccacccccaggaccctcagggccccagcctggagtggctgaagaaactgtgagcacctccactgacagaggcggcccctcccacggctcccaataaaaatgtgaaaaccaaaaaaaaaaaaaaaaaaaa

SEQ ID NO: 91 - DNA, 1110 bp, Homo sapiens
cctgggcggctccgctagctgtttttcgtcttccctaggctatttctgccgggcgctccgcgaagatgcagctcaagccgatggagatcaaccccgagatgctgaacaaagtgctgtcccggctgggggtcgccggccagtggcgcttcgtggacgtgctggggctggaagaggagtctctgggctcggtgccagcgcctgcctgcgcgctgctgctgctgtttcccctcacggcccagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttgaggatggatcagttctgaaacagtttctttctgaaacagagaaaatgtcccctgaagacagagcaaaatgctttgaaaagaatgaggccatacaggcagcccatgatgccgtggcacaggaaggccaatgtcgggtagatgacaaggtgaatttccattttattctgtttaacaacgtggatggccacctctatgaacttgatggacgaatgccttttccggtgaaccatggcgccagttcagaggacaccctgctgaaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagataaaaaaaaaaaaaaaaaa

SEQ ID NO: 92 - DNA, 3347 bp, Homo sapiens
agttgggtaccgggaggggcgaaggcgggcggcagaggcgatcagaagtttccaagggtcacttgtgtctcgtccgtgggaagaccgggggagcccagaaggccttggtgtggaattctgagagctgattcctgccttgtcttctccactgttcctggaggaatccgagaagagcagagcggagggagccccagacacggtccgcgggagagctgtggggcttggtgagtgtttcgtggcctctcgggttggtcagcacccccagccagctggcccaggacccctctacagaagtccaggagagcaggcgtcaccaagatgtccaaccccttcctgaagcaagtcttcaacaaggacaagacattccgccccaagcgcaagtttgagccaggcacccagcgcttcgagctgcacaagaaggcgcaggcgtcgctgaacgccgggctggacctgcggctggccgtgcagttgcccccgggcgaggacctgaacgactgggtggctgttcacgtggtggacttctttaaccgcgtcaacctcatctacggcaccatcagcgacggctgcacggagcagtcctgccccgtcatgtcggggggccccaagtatgagtaccgctggcaggatgagcataagttccggaagcccacggcactctccgcgcccaggtacatggacctgctgatggactggatcgaggcgcagatcaacaacgaggacctcttccccaccaacgttggcactccgtttcccaagaacttcctgcagacggtgcggaagatcctgtcgcggctgttccgcgtgttcgtgcacgtctacatccaccactttgaccgcatcgcgcagatgggctccgaggcccacgtgaacacctgctacaagcacttctactatttcgtcaaggagttcggcctcatcgacaccaaggagctggagccactgaaagaaatgaccgcccggatgtgccactgagagccccgcgggtctcccggtgcccgaaccgccgctggggcctcggagacttggaggaggacgctctggaaccatcatcccgcttctctccggcctgagcatctcagggagaccaggggccgagccgctgagcaggtgttggtcctcaggagctccaaccccggacggcagatgccttcctcagtctcgagcctcagtctcccgtctgggactaaaacgtgaactctgtaattctatgtgttactagcaaccggaaaagcccactgtgtttttaaaccacttccactttccaggaggctggatggcttccagggtcactccttgccctgggtggctcccaggctcctggaacttctgcctccacctcgctggggagcccccagggctgctgtggccacagccctgcctgggcctgtctctcaagggcacccagcttgctcggcctcctacatgtctcccgttggggaggcaagaggctgaggggcttccgagcccctgagagcggacatctcctcccgcaggcctttactccgcactccccactggcagccgctggtgtctcttcacacagaggcacaacctggacccaggcagcctctttcctccctccccaatctcttccatttttctacagatttttttttttttggtcatactagagacaggggtctcgctgaactcctggcctccagtgatcctccatcctcggcctcccaaagtgctggaatcacaggggtgagccaccgcacccagccctctctcttcctcaatgcactctgcttcttccgttcttccgaaacattcagctgactgtatccagggcttcctggactcctgggaccccacgtcctgcaccccggcttctgactcatttcctaagggcccctttgtgtatcataaagggtttgatttttatagtcacatttacaaccatcttgagatttttattttttttgaacggagtctcccactgtcgcccagactggagtccagtggcacaatctcggctcactgcatcctccacctcctgggttcaagtgattctcctgcttcagcctcccaagtagctgggattacaggtgtgcgccaccacgcccaggaaattattgtagttttagtagagacaagatttcaccatgttggccaggctggtctcaaactcctgacttcaggtgatccgcctaccttggcctccaaaagtgctgggattacaggcatgagctactgcacccggcctaaccaggctggagtgcagtggtgggatctcggctcactgcaagctccgcctcccagattcacgccattctcctgcctcagcctccccagcagctgggactacaggcacccaccgtcacacccggctaatttttttgtattttagtagagacagggtttcaccgtgttagccaggatggtcttgatctcctgaccttgtgatccaccagcctcagcctcccaaagtgctgggattacaggcgtgagccactgtgcccggccaagaatttttttatcgataacatagtgagctctctgcctcttcggaacgatgtccactttgcttatgatcaacccaagcaggactcttctctccctggacgcctctcccctggtctggaatcttccagttctgccagaattggcctttcccagatgctgcaaacttccagttgaacccctttttctgtgtggcccctggggctgcgagaccaaaatccatgagttctgtgtaccctagacctttggaaggtgagagcagggccctgagaaaaggcagccacctcctctccctggctgaacccctgccaccctactcctcaccagaattgtcagtggcctttcaccacagtggtccttcctgcctgagccctgcactgtcccagaccacacagaagtctggtcacctctgggcgcctgggatggtcaccgaagagaagcacgctgtccccgtctctcctggcttctgccagaaaatcgaacaagtgcaattaacacactgttactgccgaagcctgaaactcccaggacttgtccttgatccttccagaaaccaccaggtccggcacttggagccccccggagagggacctcccagccgagccctcaaagaactccatgaaatcaggaactgcttgatgaaatgtatctccttgtacctggaagatgaagcccaaacacccacacctctgtctcccccagggctcgggatgtctccagcagcccggccacgcagcttcccaggtgggctcggggaggtgggagcagggaccatctctgtcccctccaccctcactccatccacctcggagaccaccctcccccagccagatacggaataaaactacagacgcagacgtcggaaaaaaaaaaaaaaaaaa

SEQ ID NO: 93 - DNA, 2744 bp, Homo sapiens
ctcgtgccgaattcggcacgagaccgcgtgttcgcgcctggtagagatttctcgaagacaccagtgggcccgtgtggaaccaaacctgcgcgcgtggccgggccgtgggacaacgaggccgcggagacgaaggcgcaatggcgaggaagttatctgtaatcttgatcctgacctttgccctctctgtcacaaatccccttcatgaactaaaagcagctgctttcccccagaccactgagaaaattagtccgaattgggaatctggcattaatgttgacttggcaatttccacacggcaatatcatctacaacagcttttctaccgctatggagaaaataattctttgtcagttgaagggttcagaaaattacttcaaaatataggcatagataagattaaaagaatccatatacaccatgaccacgaccatcactcagaccacgagcatcactcagaccatgagcgtcactcagaccatgagcatcactcagaccacgagcatcactctgaccataatcatgctgcttctggtaaaaataagcgaaaagctctttgcccagaccatgactcagatagttcaggtaaagatcctagaaacagccaggggaaaggagctcaccgaccagaacatgccagtggtagaaggaatgtcaaggacagtgttagtgctagtgaagtgacctcaactgtgtacaacactgtctctgaaggaactcactttctagagacaatagagactccaagacctggaaaactcttccccaaagatgtaagcagctccactccacccagtgtcacatcaaagagccgggtgagccggctggctggtaggaaaacaaatgaatctgtgagtgagccccgaaaaggctttatgtattccagaaacacaaatgaaaatcctcaggagtgtttcaatgcatcaaagctactgacatctcatggcatgggcatccaggttccgctgaatgcaacagagttcaactatctctgtccagccatcatcaaccaaattgatgctagatcttgtctgattcatacaagtgaaaagaaggctgaaatccctccaaagacctattcattacaaatagcctgggttggtggttttatagccatttccatcatcagtttcctgtctctgctgggggttatcttagtgcctctcatgaatcgggtgtttttcaaatttctcctgagtttccttgtggcactggccgttgggactttgagtggtgatgcttttttacaccttcttccacattctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaagaatcagaagaaacctgaaaatgatgatgatgtggagattaagaagcagttgtccaagtatgaatctcaactttcaacaaatgaggagaaagtagatacagatgatcgaactgaaggctatttacgagcagactcacaagagccctcccactttgattctcagcagcctgcagtcttggaagaagaagaggtcatgatagctcatgctcatccacaggaagtctacaatgaatatgtacccagagggtgcaagaataaatgccattcacatttccacgatacactcggccagtcagacgatctcattcaccaccatcatgactaccatcatattctccatcatcaccaccaccaaaaccaccatcctcacagtcacagccagcgctactctcgggaggagctgaaagatgccggcgtcgccactttggcctggatggtgataatgggtgatggcctgcacaatttcagcgatggcctagcaattggtgctgcttttactgaaggcttatcaagtggtttaagtacttctgttgctgtgttctgtcatgagttgcctcatgaattaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtacctgaaatgctgcacaatgatgctagtgaccatggatgtagccgctgggggtatttctttttacagaatgctgggatgcttttgggttttggaattatgttacttatttccatatttgaacataaaatcgtgtttcgtataaatttctagttaaggtttaaatgctagagtagcttaaaaagttgtcatagtttcagtaggtcatagggagatgagtttgtatgctgtactatgcagcgtttaaagttagtgggttttgtgatttttgtattgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtg

SEQ ID NO: 94 - DNA, 2440 bp, Homo sapiens
aatacagagagcatggtggagcttctggacttgtatcagttggaggatgaagcctacagcagccttgcagaagctacaaccgaactctatcagtatttactacagccattccgagacatgagagaacttgccatgctacgaagacagcagatcaagatttccatggagaatgattatctgggacctcgaagaattgagagtctacaaaaagaagatgctgattggcagcggaaagctcacatggctgtactgtctattcaagatcttactgtcaagtactttgaaataacagctaaagctcaaaaagctgtgtatgatcgaatgcgagctgatcagaagaaatttggtaaagcatcatgggcagcggctgctgaacggatggaaaaactccagtatgcagtttctaaggaaactttgcagatgatgagagctaaagagatatgcttggaacagcggaaacatgcactaaaggaagagatgcagagtttgcggggtggtacagaagcgatagcacgattggatcagttagaagctgattattatgacctgcaacttcagttgtatgaagtacagtttgaaatcttgaagtgtgaagagttactattgacagcgcaactagaaagcatcaaaagacttatatcagaaaaaagagatgaagtggtatactatgacacttacgaaagcatggaggccatgctggagaaggaagagatggcagcatctgcgtacttacagagagaagagctgcagaaacttcagcagaaagcacgccagctggaagcaagacgtggacgggtttctgccaagaaatcctacctcagaaataaaaaggaaatatgtattgcaaaacacaatgaaaaaatccaacagcgcactcggattgaagatgaatatagaacccatcacacagtacaactaaagagagaaaaattacatgatgaagaagaaagaaaaagtgcctgggttagccaagagagacagagaacactggatagacttcgaacatttaaacagaggtatcctgggcaagtcatacttaaatcaaccagattacgactagctcatgcaagaagaaaaggtgcagcaagtcctgttctccaagaggatcattgtgactctttaccaagtgtgttacaggtagaagagaaaactgaagaggtgggagaaggaagagtcaagcgtgggccatcacagacaacagaaccccagagccttgtgcaacttgaagatacttcattaacacaacttgaagccacctcattacctctcagtggtgttacctctgaactgcctcccactatatctcttccacttttgaataacaacctcgaaccatgttctgttaccataaatccactcccatcccctcttcctccaacaccaccacctcccccacctcctccccctcccccaccaccaccacctctgcctgttgctaaggacagtggcccagagacactggagaaagatctgcctagaaaggaggggaatgagaagaggatcccaaagtcagccagtgccccctcagcacacctctttgacagcagccagctggtcagtgcacggaagaagctcagaaagactgctgaaggtttgcagaggaggagagtgagctcacccatggatgaggtgctagcctccttgaagcgtggtagttttcatctgaaaaaggttgaacagcgaactctgcctccttttcctgatgaagatgatagtaataatatcttggcacaaataaggaaaggggtaaaattgaagaaggtacagaaggatgttttgagagaatccttcacacttctacccgatacagaccctctaacacggagcatccatgaagctcttagaagaattaaagaagcatccccagagtcagaggacgaagaggaggctttaccttgcacagactgggagaactaacaagtgacataacagaagaaaaatatcattcaagattggttctgattcttttggaaaatgacagtttaagcacttggttcctcagttggataacattagatccaaagtgcattggttcagtggtgtgaagaaaggaagcacaattggcaggttatcactttccagtcgttccaatagatgatggttaacatgaattttacatgtgcaatgttcctgactgcaatgaagaaaaggccttctggagatttctgttttttaagcacattctccttccatccacatatttacatccttgtaatggccagttaagctagggcttgctgtaagttggaagaacactgggttgacagagatctactgtgagctgtattgggactgctttgagaaccatctttcaatgcactgaaaagtcatctgaaaaaatagcttcttccatatcagcttatattaaatactgtgacactctgagaaagtttatcatcatgatagctgtaagtcaggcattaaaatcaaatggaaatac

SEQ ID NO: 95 - DNA, 6267 bp, Homo sapiens
cttccatgtgtgaaagctacttggcatgaatgcctgggccgtaccaagtgtcaccgcagcaagagggggagtcagaagaaaaacagatcagaccaagcagacaataggcccctaaagtgttccccctaagttgctttgatgttgtcctggtgtcttgataccaggaggccagggattgcgggaaaagggtcttttttgtcttcattcactttcccccctcagtttctgaaatgattctccagaatttctcctcataaaaaaggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagttccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcttatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagccggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccggggcattttcagcggccctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaagagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggacccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttaagttcaagtgctcttcagcactgtcttgtctcccaatataccaacccactggcacattttctctgtttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaagtctgtcctgggatgcttctctgtcttttttccccctaagtctttctctttcccatcatacccttccctgccccaccttgttttctgttccccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttctta

SEQ ID NO: 96 - DNA, 3877 bp, Homo sapiens
atgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcccaaagcttaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 97 - DNA, 1044 bp, Homo sapiens
gaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacgggtcgcggcgagcgcgcctatgacatctactcgcggctgctgcgggagcgcatcgtgtgcgtcatgggcccgatcgatgacagcgttgccagccttgttatcgcacagctcctcttcctgcaatccgagagcaacaagaagcccatccacatgtacatcaacagccctggtggtgtggtgaccgcgggcctggccatctacgacacgatgcagtacatcctcaacccgatctgcacctggtgcgtgggccaggccgccagcatgggctccctgcttctcgccgccggcaccccaggcatgcgccactcgctccccaactcccgtatcatgatccaccagccctcaggaggcgcccggggccaagccacagacattgccatccaggcagaggagatcatgaagctcaagaagcagctctataacatctacgccaagcacaccaaacagagcctgcaggtgatcgagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcttgccagacccccagctgggccctgctcaccccttgttgctgggcttggaggggcctcttgaggaacttttaatttgcaggggtgcccgctatggacggggcattccagctgagacactgtgattttaaattaaatctttgtggtctt

SEQ ID NO: 98 - DNA, 3100 bp, Homo sapiens
atggctgtcagagagttgtgcttcccaagacaaaggcaagtcctgtttctttttcttttttggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcacgcgccagtatttcaggacaaagaaacagtcttaaaaatatcagaaaatacagctgaagggacagcatttagactagaaagagcacaggatccagatggaggacttaacggtatccaaaactacacgatcagccccaactcttttttccatattaacattagtggcggtgatgaaggcatgatatatccagagctagtgttggacaaagcactggatcgggaggagcagggagagctcagcttaaccctcacagcgctggatggtgggtctccatccaggtctgggacctctactgtacgcatcgttgtcttggacgtcaatgacaatgccccacagtttgcccaggctctgtatgagacccaggctccagaaaacagccccattgggttccttattgttaaggtatgggcagaagatgtagactctggagtcaacgcggaagtatcctattcattttttgatgcctcagaaaatattcgaacaacctttcaaatcaatcctttttctggggaaatctttctcagagaattgcttgattatgagttagtaaattcttacaaaataaatatacaggcaatggacggtggaggcctttctgcaagatgtagggttttagtggaagtattggacaccaatgacaatccccctgaactgatcgtatcatcattttccaactctgttgctgagaattctcctgagacgccgctggctgtttttaagattaatgacagagactctggagaaaatggaaagatggtttgctacattcaagagaatctgccattcctactaaaaccttctgtggagaatttttacatcctaattacagaaggcgcgctggacagagagatcagagccgagtacaacatcactatcaccgtcactgacttggggacacccaggctgaaaaccgagcacaacataacggtcctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaagacccgcacctgcccctcgcctccctggtctccatcaacgcggacaacggccacctgttcgccctcaggtcgctggactacgaggccctgcaggctttcgagttccgcgtgggcgccacagaccgcggctcccccgcgctgagcagagaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctcgtggtgcttgtcaaggacaatggcgagcctcctcgctcggccaccgccacgctgcacttgctcctggtggacggcttctcccagccctacctgcctctcccggaggcggccccggcccaggcccaggccgaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgaggggcgctgagaccctgtcccagagctaccagtatgaggtgtgtctgacgggaggccccgggaccagtgagttcaagttcttgaaaccagttatttcggatattcaggcacagggccctgggaggaagggtgaagaaaattccaccttccgaaatagctttggatttaatattcagtaaagtctgtttttagtttcatatacttttggtgtgttacatagccatgtttctattagtttacttttaaatctcaaatttaagttattatgcaacttcaagcattattttcaagtagtatacccctgtggttttacaatgtttcatcatttttttgcattaataacaactgggtttaatttaatgagtatttttttctaaatgatagtgttaaggttttaattctttccaactgcccaaggaattaattactattatatctcattacagaaatctgaggttttgattcatttcagagcttgcatctcatgattctaatcacttctgtctatagtgtacttgctctatttaagaaggcatatctacatttccaaactcattctaacattctatatattcgtgtttgaaaaccatgtcatttatttctacatcatgtatttaaaaagaaatatttctctactactatgctcatgacaaaatgaaacaaagcatattgtgagcaatactgaacatcaataatacccttagtttatatacttattattttatctttaagcatgctacttttacttggccaatattttcttatgttaacttttgctgatgtataaaacagactatgccttataattgaaataaaattataatctgcctgaaaatgaataaaaataaaacattttgaaaaaaaaaaaaaaaaaaa

SEQ ID NO: 99 - DNA, 195 bp, Homo sapiens
tcacgtgacccgggcgcgctgcggccgcccgcgcggacccggcgagaggcggcggcgggagcggcggtgatggacgggtccggggagcagcccagaggcggggtttcatccaggatcgagcagggcgaatggggggggaggcacccgagctggccctggacccggtgcctcaggatgcgtccaccaagaagctga

SEQ ID NO: 100 - DNA, 5888 bp, Homo sapiens
atatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattctccccgcccggagctgcggcttcccggtgttgaagatcccccggaccaggggcgagggctacccgctctttgccgtgacaacaccgttcccccagccgggctggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgagaccctgaggaagaagggcttcaatggctgcgacagccccgagcccgacggggaggactcgctggaacagagccccctgctggaggacaagtaccgacgcgccagcgaggagctcgacgggctcttccggcgctatgggtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggggccatgctggggggtgacctgaacagtgctaacggagcctgccccagccctgttgggaatggctacgtcagtgctcgggcttcccctggcctcctccctgtggccaatggcaacagcctaaacaaggtcatccctgccaagtctccgcccccacctacccacagcacccagcttggagcccccagccgcaagcccgacctgcgagtcatcacttcccaggcaggaaaggggttaatgcatcacttgactgaggaccatttagatctgaacaatgcccagcgccttggggtctcccagtctactcattcgctcaccaccccagtggtttctgtggcaacgccgagtttactcagccagggcctccccttctcttccatgcccactgcctacaacacagattaccagttgaccagtgcagagctctcctccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctggacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagtcgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagccagggtgtaatcttgttcatgcatgcgtccccagagcctcgcccagtgcctggcacatagtaggcactcaataaatgctgaatgggtgaatagttgaatgataggtgctcaataaatgaatgaatggccttcccttctcaggctattcccaacattagtctgcccacctttctaggctgggcttggccaccattaaacacggggtgggggtgagggcccctgcaattcacggtgcaatattcaccagttttgccctctgcctcataaaggcaaacctggcttttgattaccatgtgtggatgtttcagtgtcctttcttctctgtccctggggatggggtggtctgtgaatatgtgacatttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgataaaaaaaaaaaaaaa

SEQ ID NO: 101 - DNA, 1462 bp, Homo sapiens
ggcaagcgccggtggggcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccatcttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgagaaaaaaaaaaaaaaaaaa

SEQ ID NO: 102 - DNA, 2446 bp, Homo sapiens
gggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggaaagaatctctatacaaatgaatacgtggctatcaaattggagccgatcaagtcccgggccccgcagctgcacctggagtaccggttctacaagcagctcagcgccacagagggcgtccctcaggtctactacttcggtccgtgcgggaattacaacgccatggtgctggagctgctggggcccagcctggaggacctgttcgacctgtgcgaccggaccttcacgctcaagacggtgctgatgatcgccatccagctgatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaaggagcagagccgccgcgacgacctggaggcgctgggccacatgttcatgtacttcctgcgcggcagcctcccctggcaggggctcaaggccgacacgctcaaggagcggtaccagaagatcggggacaccaaacgcgccacgcccatcgaggtgctctgcgagaacttcccagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctgccgacccccatcggcaccgtccacaccgacctgccctcccagcctcagctccgggacaaaacccagccgcacagcaaaaaccaggcgttgaactccaccaacggggagctgaatgcggacgaccccacggccggccactccaacgccccgatcacagcgcctgcagaggtggaggtggccgatgaaaccaaatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaaaaaaaaaaaaaa

SEQ ID NO: 103 - DNA, 1965 bp, Homo sapiens
gtctggttctctctctccagaaggttctgccggttcccccagctctgggtacccggctctgcatcgcgtcgccatgatgggccatcgtccagtgctcgtgctcagccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgaaaaaaaaaaaaaaaaaaaaaaaa

SEQ ID NO: 104 - DNA, 1313 bp, Homo sapiens
aattggaggagttgttgttaggccgtcccggagacccggtcgggagggaggaaggtggcaagatggtgttggaaagcactatggtgtgtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaatgactgtgaagtgctgaccacactcaccccagacactggccgtatcctgtccaagctacatactgtccaacccaagggcaagatcaccttctgcacgggcatccgcgtggcccatctggctctgaagcaccgacaaggcaagaatcacaagatgcgcatcattgcctttgtgggaagcccagtggaggacaatgagaaggatctggtgaaactggctaaacgcctcaagaaggagaaagtaaatgttgacattatcaattttggggaagaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggcccttcgtgtatctatggaagagcagcggcagcggcaggaggaggaggcccggcgggcagctgcagcttctgctgctgaggccgggattgctacgactgggactgaagactcagacgatgccctgctgaagatgaccatcagccagcaagagtttggccgcactgggcttcctgacctaagcagtatgactgaggaagagcagattgcttatgccatgcagatgtccctgcagggagcagagtttggccaggcggaatcagcagacattgatgccagctcagctatggacacatctgagccagccaaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttt

SEQ ID NO: 105 - DNA, 534 bp, Homo sapiens
cgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccaccca

SEQ ID NO: 106 - DNA, 2109 bp, Homo sapiens
ttgctgcatagattacaacggtgatggcgggcaagcggtccggctggagccgggcggctctcctccagctccttctcggcgtgaacctggtggtgatgccgcccacccgggcccggagtctgcgcttcgttaccttgctgtaccgccatggagaccgttcaccagtgaagacatatcccaaggacccctatcaggaagaagaatggccccaggggtttggtcagttaaccaaggaggggatgctacagcactgggaactgggccaggccctgcggcagcgctatcacggcttcctaaacacctcttatcaccggcaagaggtttatgtgcgaagcacagactttgaccggactctcatgagtgctgaggccaacctggctggactcttccctcccaacgggatgcagcgcttcaacccgaacatctcgtggcagcctattcctgtgcacactgtgcccatcactgaggacaggctgctgaagttcccgttgggcccatgtccccgttatgagcagctgcagaacgagacccggcagacaccagagtatcagaatgagagttctcggaatgcacaatttctggacatggtggccaacgagacagggcttacagacctgacactggagaccgtctggaatgtctatgacacactcttctgtgagcaaacgcacgggctgcgcctgccgccctgggcctcaccccaaaccatgcagcgtctcagccggctaaaggacttcagcttccgcttcctcttcggaatctaccagcaggcggagaaggcccggcttcaggggggagtcctgctggctcagataaggaagaacctgaccctaatggcgaccacctcccagctccccaagctgctggtttactctgcgcacgacactaccctggttgccctgcaaatggcactggatgtctacaatggtgaacaagccccctacgcctcctgccacatatttgaactgtaccaggaagattctgggaatttctcagtggagatgtactttcggaacgagagtgacaaggccccctggccgctcagcctgcctggctgccctcaccgctgcccactgcaggacttccttcgcctcacagagcccgtcgtgcccaaggattggcagcaggagtgccagctggcaagcggtcctgcagacacagaggtgattgtggccttggctgtatgtggctccatcctcttcctcctcatagtgctgctcctcaccgtcctcttccggatgcaggcccagcctcctggctaccgccacgtcgcagatggggaggaccacgcctgacaaccactcagcccccttccctccacctcctaggggaggtgggctgggccctcgctcctgactgttgctgctccccagcccatggacaggagatcctgggttgggcctccctctgatgaccccagccagatgagcgagtggggctcagcgtggcccatggtgcctgtcactcagcattcccatgcctgatgtttaccaagtgctgtgttggacactggctttctccaaacaggatttgcctcctccacgctccctacacacctgagatgtaaactggcagtcagtgttcactcaggacctaggattagaaaatggcagagttggtgctggatccaccttgcacttctatcaagccctgttctttttcctccagcctgaagtcttcggcaaatagctcagagggacacggtcttgcctctcagtgcttattttagtgggaaaaacagctaataccaggggtacaaacattggctcccaaggaactggatcacccaacagccagccagccacatttccctgtgtctggctagagccaccattagactcagacagaatgcttcaggaatcgttgtcaccccttcaactggagcaggacggaaggttgtctgtacttgggagggagtggggagtggtgggaagggagttgcttgtcacacgaatcaggaaactgctctccctcagctgggctggggtctccagggacctgagctacatgcaggttgtgagctggaaaagaaagttctagactgtggcccagaatagggctggggcagctcccagagaatgaatagtgctgtttcctattggactgata

SEQ ID NO: 107 - DNA, 2807 bp, Homo sapiens
gggggagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaaggctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaaaaaaaaaaaaaaaa

SEQ ID NO: 108 - DNA, 2787 bp, Homo sapiens
gcacagacgagatctcgatcgaaggcgagatggcggacgtgctagatcttcacgaggctgggggcgaagatttcgccatggatgaggatggggacgagagcattcacaaactgaaagaaaaagcgaagaaacggaagggtcgcggctttggctccgaagaggggtcccgagcgcggatgcgtgaggattatgacagcgtggagcaggatggcgatgaacccggaccacaacgctctgttgaaggctggattctctttgtaactggagtccatgaggaagccaccgaagaagacatacacgacaaattcgcagaatatggggaaattaaaaacattcatctcaacctcgacaggcgaacaggatatctgaaggggtatactctagttgaatatgaaacatacaaggaagcccaggctgctatggagggactcaatggccaggatttgatgggacagcccatcagcgttgactggtgttttgttcggggtccaccaaaaggcaagaggagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgct

SEQ ID NO: 109 - DNA, 2389 bp, Homo sapiens
gcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacaggtactagaagatatgttttatctttttttaactttatttgactaatatgactgtcaatactaaaatttagttgttgaaagtatttactatgtttttt

SEQ ID NO: 110 - DNA, 691 bp, Homo sapiens
cccgcgcaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttaaaa

SEQ ID NO: 111 - DNA, 648 bp, Homo sapiens
ctttccggacctggccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttcctggccgggaaaacaagacggccgtggttgtggggaccataactgatgatgtgcgggttcaggaggtacccaaactgaaggtatgtgcactgcgcgtgaccagccgggcccgcagccgcatcctcagggcagggggcaagatcctcactttcgaccagctggccctggactcccctaagggctgtggcactgtcctgctctccggtcctcgcaagggccgagaggtgtaccggcatttcggcaaggccccaggaaccccgcacagccacaccaaaccctacgtccgctccaagggccggaagttcgagcgtgccagaggccgacgggccagccgaggctacaaaaactaaccctggatcctactctcttattaaaaagatttttgctgacaaaaaaaa

SEQ ID NO: 112 - DNA, 428 bp, Homo sapiens
ccttccgccacggccgtctctggagagcagcagccatggccctacgctaccctatggccgtgggcctcaacaagggccacaaagtgaccaagaacgtgagcaagcccaggcacagccgacgccgcgggcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtggggacgcacatccgcgccaagaggaagcgggaggagctgagcaacgtactggccgccatgaggaaagctgctgccaagaaagactgagcccctcccctgccctctccctgaaataaagaacagcttgacaggaaaaaaaaaaaaaaaaaaaaaaaaaaaaaa

SEQ ID NO: 113 - DNA, 2985 bp, Homo sapiens
ggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtaaaaaaaaaaaaaaaaa

SEQ ID NO: 114 - DNA, 787 bp, Homo sapiens
gtctgaaggccgaggccaagatggcggtgctgtcagctcctggcctgcgcggcttccggatccttggtctgcgctccagcgtgggcctggctgtgcaggcacgaggtgtccatcagagcgtggccaccgatggcccaagcagcacccagcctgccctgccaaaggccagagccgtggctcccaaacccagcagccggggcgagtatgtggtggccaagctggatgacctcgtcaactgggcccgccggagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtctacgaccagatgccggagccgcgctacgtggtctccatggggagctgcgccaacggaggaggctactaccactattcctactcggtggtgaggggctgcgaccgcatcgtgcccgtggacatctacatcccaggctgcccacctacggccgaggccctgctctacggcatcctgcagctgcagaggaagatcaagcgggagcggaggctgcagatctggtaccgcaggtagcgccgccgccgccgccgccggagcctgtcgccgtcctgtccccagcctgcttgtgtcccgtgaggttgtcaataaacctgccctcgggctgccgcaaaaaaaaaaaaaaaaaaagaaaaaaaaaa

SEQ ID NO: 115 - DNA, 2809 bp, Homo sapiens
acttccggaatctctcggcgtgtgagcttggttgtcctaccaaagccagcgtttcggctcgcgtgcgccggcctagtttgctcgcgccctcacgcgctttgggtttcccggtctcatggccggcctgaccttatttgtgggccgcctcccgccctcggcccgcagtgagcagctggaggaactgttcagtcaggtggggccggtgaagcagtgcttcgtggtgactgaaaaagggagtaaggcatgtcgaggctttggctatgtcactttttcaatgctggaagatgttcagagggccctcaaggagattaccacctttgaaggttgcaagatcaacgtgactgttgccaagaaaaaactgaggaacaagacaaaggaaaaggggaaaaatgaaaactcagagtgcccaaagaaggagccgaaggctaaaaaagccaaagtggcagataagaaagccagattaattattcggaacctgagctttaagtgttcagaagatgacttgaagacagtatttgctcaatttggagctgtcctggaagtaaatatccctaggaaaccagatgggaagatgcgcggttttggttttgttcagttcaaaaacctcctagaagcaggtaaagctctcaaaggcatgaacatgaaagagataaaaggccggacagtggctgtggattgggccgtggcaaaggataaatataaagatacacagtctgtttctgctataggtgaggaaaagagccatgaatctaaacatcaggaatcagttaaaaagaagggcagagaggaagaggatatggaagaggaagaaaacgatgatgatgacgatgatgatgatgaagaagatggggtttttgatgatgaagatgaagaggaagagaatatagaatcaaaggtgaccaagcctgtgcaaattcagaagagagcagtcaagagaccagcccctgcaaaaagcagtgatcattctgaggaggacagtgacctagaggaaagcgatagtattgatgatggagaggaactggctcagagtgataccagcactgaggagcaagaggataaagctgtgcaagtctcaaacaaaaagaagaggaaattaccctctgatgtgaatgaagggaaaactgtttttatcagaaatctgtcctttgactcagaagaagaagaacttggggagcttctccaacagtttggagaactcaaatatgtccgcattgtcttgcatccagacacagagcattctaaaggttgtgcatttgcccagttcatgactcaagaagcagctcagaaatgccttctagctgcttctccagagaatgaggctggtgggcttaaactggatggccggcagctcaaggttgacttggcggtgacccgtgatgaggctgcaaagcttcagacgacgaaggtgaagaagccgactggcacccggaatctctatctggcccgagaaggcttgattcgtgctgggacgaaggctgcagagggtgtgagtgctgctgatatggccaaaagagaacggtttgagctgctgaagcatcagaaactcaaggaccagaatatctttgtctcccgaaccaggctctgcctgcacaatctcccaaaggctgtagatgacaaacagctcagaaagctgctgctgagtgctactagtggagagaaaggggtgcgcatcaaggagtgtagagtgatgcgagacctcaaaggagttcatgggaacatgaagggtcagtccctgggctacgcctttgcggagttccaagagcacgagcatgccctgaaagccctccgcctcatcaacaacaatccagaaatctttgggcctctgaagagaccaatagtggagttctctttagaagatcgaagaaaacttaaaatgaaggaattaaggatccagcgcagcttgcaaaaaatgagatccaagcctgcaactggtgagcctcagaaggggcaaccagagcctgcaaaagaccagcaacagaaggcagctcaacaccacacagaggaacaaagcaaggtgcccccagagcagaagagaaaggcgggctctacctcatggaccgggttccagaccaaggctgaagtggagcaggtggagctgcctgatggaaagaagagaagaaaggtcctggcgctcccctcacaccgaggccccaaaatcaggttgcgggacaaaggcaaagtgaagcccgtccatcccaaaaagccaaagccacagataaaccagtggaagcaggagaagcagcaattatcgtccgagcaggtatctaggaaaaaagctaagggaaataagacggaaacccgcttcaaccagctggtcgaacaatataagcggaaattattgggaccttctaaaggagcacctcttgcaaagaggagcaaatggtttgatagttgatgatggcagcaggctgggtaagaagctgggttgtgtactttctggtgacactcctgggctcctccccatcccccgtgtctctcactgagggaaagaaaatccccaagggcactgccactgtgctcggaggtgccctggactgtgtacatctgaactttggtccatcctttgatgtgtggttcgttagccacaaagagaaatatctgaaagtcaacatgatgcttcttgcatattatccagattattgtatgaagttgtgtctataattattaccaattttttattctttatttctcaaatggaaacacctgaaaaagcattctggagtgctgaatttttaagatgtatattttgttaagcatattctctaaatgagatattgtgtggctttttagtaacaacgtcatttctaat

SEQ ID NO: 116 - DNA, 5834 bp, Homo sapiens
ggagccgccactgccgccgccattttgtgtctgtggagaaagaagcttctgtggcggctggaagtggacggagatcacccgcgagacggcggcgtttcatacccgaggttccccctgtgtcgtcccccatcccccctccgcggtcagcatgtggtgaagccggagccgcgagagagccggggagaggaagaggagtcggaagggaggcggggtatccagagcggcttcagcttcagctgcagcggacctcggaggggggccgcggcgcaatgtcagagcagacgccggccgaggccggtgctgcgggggcccgggaggacgcctgtcgggattatcagtcatcgctcgaagacctgaccttcaatagcaagccgcacatcaatatgctgaccattctagccgaggagaacctgcccttcgccaaggagatcgtctctctcatcgaggcccaaaccgccaaggctccttcctcagagaagcttcctgttatgtaccttatggattctattgtgaaaaacgttggaagagagtatctcactgcctttactaaaaatctagttgcaacatttatttgtgtgtttgaaaaggtggatgaaaatactaggaaaagtttatttaagttacgttctacatgggatgaaatattccctttgaagaaactttatgccctggatgtcagagtcaattcattagatcctgcttggcctattaaacctctaccccccaatgtgaatacgtctagcatccatgtgaatcctaaatttttaaataaatcgcccgaggagccttcaacacctggtacagtggtcagttcccctagcatctccactcctccaattgttcctgatatacaaaagaatcttacacaagaacaactaataaggcagcagttactggcaaagcaaaaacagttgttagaacttcagcagaaaaagctggagcttgagctagagcaagctaaggcacagttggcagtttctcttagtgttcagcaggaaacatccaatttaggtcctggatctgcaccatccaaattacatgtttcacagattccccctatggcagttaaagctcctcatcaggttcctgtgcaatctgagaaaagccgtccaggaccatccttacaaattcaggatttaaaaggaactaaccgggatcctcgtctgaacaggataagccaacattctcatggaaaagatcagagtcacaggaaagaatttctaatgaacacattaaaccagtctgatactaagacaagtaaaactataccctctgaaaaactaaattcatccaagcaagaaaaaagtaaatcaggtgaaaaaataaccaagaaagaacttgaccaattagattctaaatcgaaatcgaaatcgaaatcaccctcacctttgaaaaacaaattatctcacacaaaagacttgaaaaatcaagaatcggaaagtatgaggttgtctgatatgaacaagagagatccaagattaaaaaaacatcttcaggataagaccgatggcaaagatgatgatgtgaaagagaagagaaaaactgcagaaaaaaaggataaagatgagcacatgaagtcatccgaacacagactggctggaagtagaaataaaatcataaatggcattgtacaaaaacaggatacaataacagaagagtcagaaaaacaggggacaaaaccagggagatcgagtactagaaagcgatcaagatctcgatcacccaagtctaggtcaccaattatacattccccaaagagaagagataggcggtcacccaaacgaaggcaaagaagtatgtctccaacatcgacacctaaagctggaaagattcgccaatctggagctaagcagtcacatatggaagagtttacaccaccttctagggaagacagaaatgctaagagaagtactaaacaggatattcgggatccaaggcgaatgaaaaagactgaagaggagcgaccacaagaaactacaaatcagcattctacaaagtcaggcactgaaccaaaggagaatgtagaaaactggcaaagttccaagtctgccaaaagatggaaatctggttgggaagaaaataaaagcttacaacaggttgatgaacatagtaaacctcctcatctgaggcatagggagagctggtcaagcactaaaggaattttatcacctcgagccccaaagcagcaacagcatcgattaagtgtagatgccaatcttcagattcctaaagagttaactcttgcaagcaaaagagaattacttcaaaagacgagtgaacgtttagcatctggtgaaattacacaggatgacttccttgttgttgtgcatcaaattcgacagctatttcagtatcaagaaggtgtgcgagaagagcagagatctccattcaatgatcgttttccacttaagcgacctcgatatgaagattcagataaaccatttgtagatagtccagcatcaagattcgccggcctggatacaaatcagcgacttacagctttagctgaagacagaccgttatttgatggacctagtaggccatcagtagcaagagatggcccaacgaagatgatttttgaaggacccaataaattaagccctcgaattgatggacctcccacaccagcttctcttcggtttgatgggtcaccaggacaaatggggggaggaggccctttgagatttgaggggccacaaggtcagctaggaggtgggtgtcctttgagatttgaaggtcctccaggaccagtggggacacctctgcggtttgagggcccaattggtcaagcaggaggaggtggttttcggtttgaaggttcccctggtctgaggtttgagggatctccaggtggtttgagatttgagggaccaggaggccagcctgtgggtggtctgaggtttgagggacatcgtggtcaacctgtgggtggtctaaggtttgagggacctcatggtcagcctgtgggtggacttagatttgataatccccgaggtcagcctgtaggtggacttagatttgaggggggtcatggtccatcaggggctgcgattaggtttgatggacctcatggtcagccaggaggtggaatcagatttgagggccctttgctacagcaaggggttggaatgaggtttgagggcccccatggtcagtcagtagctggtctgagatttgagggacaacataatcaacttggtgggaaccttaggtttgagggtccacatggtcagccaggggttggtatcaggtttgaaggccctttagtccaacaaggaggtggaatgaggtttgagggtccttctgtaccaggaggtggcctgagaattgaagggcctctgggtcaaggtggtccaagatttgaaggttgtcatgctttaaggtttgatgggcagccaggtcagccgtcactcttgccaagatttgatggattacatggtcagccaggtcctagatttgaaaggactcctggtcagccaggccctcagaggtttgatggaccacctggacagcaggttcaacccagatttgacggtgtacctcaaagatttgatggtccacaacatcagcaagcatcaaggtttgatattcctcttggtcttcaaggcacaagatttgacaatcatccttcacaaaggcttgaatcagtatctttcaatcagactggtccatataatgatccacctggcaatgcttttaatgccccatcccaaggactacagttccaaagacatgaacaaatatttgattcacctcaaggaccaaattttaatggaccacatggccctggaaaccagagtttctctaatccacttaacagagcttctggacactattttgatgaaaaaaatcttcagagttctcaatttggaaactttggcaatatacctgctccaatgacagtaggaaatattcaggcatctcaacaggttctgagtggtgttgctcagccagtagcttttggtcaaggacaacagtttttaccagttcatccacaaaatcctggatttgttcagaatccttcaggagccctccctaaggcatatcctgataatcatctcagtcaggtggatgtaaatgaattgttttcaaaattgctaaaaacaggaattctcaaattgtcccaaactgattcagctacaacacaagtaagtgaagtaactgctcagcctccccctgaagaggaggaagatcaaaatgaagatcaagatgttccagatcttactaattttacagttgaagaattgaaacaacgttatgacagtgttataaatcgactgtacactggtattcagtgttactcttgtggaatgaggtttacaacatcacagacagatgtttatgcagatcatttggactggcattatcggcaaaatagaactgaaaaggatgttagccgaaaagtcactcatagacgttggtactacagtttaacagactggatagaatttgaggagatagctgatctggaagaacgggcaaagagccagttttttgaaaaggtgcatgaagaagttgtgctcaaaactcaagaggctgctaaagaaaaagagttccaaagtgtacctgctggaccagctggagcagttgagagttgtgaaatctgtcaagaacaatttgaacaatactgggatgaagaagaggaggaatggcatttgaaaaatgctattagagtagatggaaagatttatcatccatcatgttatgaagattatcaaaatacatcttcatttgattgtacaccatctcccagcaagacaccagttgaaaaccccttgaatattatgttgaacattgtcaaaaacgaattgcaggaaccctgtgacagtcccaaagttaaggaagaacgaattgatacaccaccagcttgtacagaggaaagcatagcaacaccctctgaaattaaaacagaaaatgacacagtcgagtcagtttaaataaaatgagaaaggtatgtttttcttttttaaaaaagctgctgttggatctagaaggtgaagaatttttttatgtatatatagacatatctatataaattgtctggctgaggcagggccttcagctatcatttggttaataaatacattttagtatttgcatttcctactgcctgcagagtttcaggtgcttgttgtgtgaaagttctgtagatgtgtgcaaatttaacgaaatgaaattgtatgtgtaaaaatgtacgatttttcactgtgcaactgtaaattataaataaaaaatatttttgctattcatggagtgtaatatttatgcacaccatcaaatagtttctgtactttttattgggtaaaaatggaattgaacagcaacctcaacataagattttttttctagtagcctcccactgattaaagaagcaagtttgaggtttcatccttcaaaagggggttccgagagagcaccgtagggcttttctcaaatagaaaagccagattttgaaaaaattttaaagataaaataggacatattttgcagatatatatatatatatacacaaacacatctccaggtatagagaaccatccagatgttcacttttgaaaatatctaatgatgcaaagttttattcttgaacttggacactgatgccatcaaacaattaacaaatatatttaagtactaaaggtgattttttttttaaagactttttcaaattgtcaaatgatttaatgcagatgaacatatttctattttaagtaacgggaatctgtaagaatgtttgcttgagatatggttaacttttttcttttgttggttttgacttagatggacaccatgagatgttaatattcatacatgtaataaatagaatgatgaag

SEQ ID NO: 117 - DNA, 1652 bp, Homo sapiens
aaaaggggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagagtgttgatgtaggctttattttaagcagtaatgggttacttctgaaacatcacttgtttgcttaattctacacagtacttagattttttttactttccagtcccaggaagtgtcaatgtttgttgagtggaatattgaaaatgtaggcagcaactgggcatggtggctcactgtctgtaatgtattacctgaggcagaagaccacctgagggtaggagtcaagatcagcctgggcaacatagtgagacgctgtctctacaaaaaataattagcctggcctggtggtgcatgcctagtcctagctgatctggaggctgacgtgggaggattgcttgagcctagagtgagctattatcatgccactgtacagcctgggtgttcacagatcttgtgtctcaaaggtaggcagaggcaggaaaagcaaggagccagaattaagaggttgggtcagtctgcagtgagttcatgcatttagaggtgttcttcaagatgactaatgtcaaaaattgagacatctgttgcggttttttttttttttttttcccctggaatgcagtggcgtgatctcagctcactgcagcctccgcctcctgggttcaagtgattctagtgcctcagcctcctgagtagctgggataacgggcgtgtgccaccatgcccagctaatttttgtatttttagtatagatggggtttcatcattttgaccaggctggtctcaaactcttgacctcagctgatgcgcctgccttggcctcccaaactgctgagattacagatgtgagccaccgcaccctacctcattttctgtaacaaagctaagcttgaacactgttgatgttcttgagggaagcat

SEQ ID NO: 118 - DNA, 2191 bp, Homo sapiens
cacgggcggagccggggccatggagccgccgctgccgggctaggcaggtcgtgccccgccgggccggcggcgatgtcgggctaccagcgccacccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatggggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggcgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaaattaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcagtgttttccagtcccatcccagaacatcagttgtaagataagtacaattggttgtccttgatttcataagtagaacaaacactaaatgtgcctctgagatggccaccccgggcagggacctgtgccttccaccgatgctcagggctccctctggctcccgggtcactcttgtggccccagtgggtggtccctgcagtcatggcctgagtgcgcaggggccaccgcgtggctgccgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccaaaaaaaaaaaaaaaaa

SEQ ID NO: 119 - DNA, 4691 bp, Homo sapiens
gagaaggacgcgcggcccccagcgctcttgggggccgcctcggagcatgacccccgcgggccagcgccgcgcgcctgatccgaggagaccccgcgctcccgcagccatgggcaccgggggccggcggggggcggcggccgcgccgctgctggtggcggtggccgcgctgctactgggcgccgcgggccacctgtaccccggagaggtgtgtcccggcatggatatccggaacaacctcactaggttgcatgagctggagaattgctctgtcatcgaaggacacttgcagatactcttgatgttcaaaacgaggcccgaagatttccgagacctcagtttccccaaactcatcatgatcactgattacttgctgctcttccgggtctatgggctcgagagcctgaaggacctgttccccaacctcacggtcatccggggatcacgactgttctttaactacgcgctggtcatcttcgagatggttcacctcaaggaactcggcctctacaacctgatgaacatcacccggggttctgtccgcatcgagaagaacaatgagctctgttacttggccactatcgactggtcccgtatcctggattccgtggaggataatcacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccaatacgtcattcacaacaacaagtgcatccctgagtgtccctccgggtacacgatgaattccagcaacttgctgtgcaccccatgcctgggtccctgtcccaaggtgtgccacctcctagaaggcgagaagaccatcgactcggtgacgtctgcccaggagctccgaggatgcaccgtcatcaacgggagtctgatcatcaacattcgaggaggcaacaatctggcagctgagctagaagccaacctcggcctcattgaagaaatttcagggtatctaaaaatccgccgatcctacgctctggtgtcactttccttcttccggaagttacgtctgattcgaggagagaccttggaaattgggaactactccttctatgccttggacaaccagaacctaaggcagctctgggactggagcaaacacaacctcaccaccactcaggggaaactcttcttccactataaccccaaactctgcttgtcagaaatccacaagatggaagaagtttcaggaaccaaggggcgccaggagagaaacgacattgccctgaagaccaatggggacaaggcatcctgtgaaaatgagttacttaaattttcttacattcggacatcttttgacaagatcttgctgagatgggagccgtactggccccccgacttccgagacctcttggggttcatgctgttctacaaagaggccccttatcagaatgtgacggagttcgatgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccaacccctctgtgcccctggatccaatctcagtgtctaactcatcatcccagattattctgaagtggaaaccaccctccgaccccaatggcaacatcacccactacctggttttctgggagaggcaggcggaagacagtgagctgttcgagctggattattgcctcaaagggctgaagctgccctcgaggacctggtctccaccattcgagtctgaagattctcagaagcacaaccagagtgagtatgaggattcggccggcgaatgctgctcctgtccaaagacagactctcagatcctgaaggagctggaggagtcctcgtttaggaagacgtttgaggattacctgcacaacgtggttttcgtccccagaaaaacctcttcaggcactggtgccgaggaccctaggccatctcggaaacgcaggtcccttggcgatgttgggaatgtgacggtggccgtgcccacggtggcagctttccccaacacttcctcgaccagcgtgcccacgagtccggaggagcacaggccttttgagaaggtggtgaacaaggagtcgctggtcatctccggcttgcgacacttcacgggctatcgcatcgagctgcaggcttgcaaccaggacacccctgaggaacggtgcagtgtggcagcctacgtcagtgcgaggaccatgcctgaagccaaggctgatgacattgttggccctgtgacgcatgaaatctttgagaacaacgtcgtccacttgatgtggcaggagccgaaggagcccaatggtctgatcgtgctgtatgaagtgagttatcggcgatatggtgatgaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactatttagacgtcccgtcaaatattgcaaaaattatcatcggccccctcatctttgtctttctcttcagtgttgtgattggaagtatttatctattcctgagaaagaggcagccagatgggccgctgggaccgctttacgcttcttcaaaccctgagtatctcagtgccagtgatgtgtttccatgctctgtgtacgtgccggacgagtgggaggtgtctcgagagaagatcaccctccttcgagagctggggcagggctccttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgcgcctcctgggagtggtgtccaagggccagcccacgctggtggtgatggagctgatggctcacggagacctgaagagctacctccgttctctgcggccagaggctgagaataatcctggccgccctccccctacccttcaagagatgattcagatggcggcagagattgctgacgggatggcctacctgaacgccaagaagtttgtgcatcgggacctggcagcgagaaactgcatggtcgcccatgattttactgtcaaaattggagactttggaatgaccagagacatctatgaaacggattactaccggaaagggggcaagggtctgctccctgtacggtggatggcaccggagtccctgaaggatggggtcttcaccacttcttctgacatgtggtcctttggcgtggtcctttgggaaatcaccagcttggcagaacagccttaccaaggcctgtctaatgaacaggtgttgaaatttgtcatggatggagggtatctggatcaacccgacaactgtccagagagagtcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccagtggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattcttttttttttttttttttttttttttttgctggtgtctgagcttcagtataaaagacaaaacttcctgtttgtggaacaaaatttcgaaagaaaaaaccaaa

SEQ ID NO: 120 - DNA, 1196 bp, Homo sapiens
aggtccggcttaccgtcgtttacgacagtgtcaggatcgcgggcttgctttccggtagcgtgggctgacgcctcgctcaatttctcacagggctgcgcaggtttcccccgtctgcgaatggaccactggaggggttcaaaggttcgcgtcccagtacgggaatgagcctctttgatctcttccggggctttttcggctttcctggacctcggagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctgaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcataggtttgatgatgtatggcctatggacccccatcctagaaccagagaggacaatgatcttgattcccaggtttcccaggagggtcttggcccggttctacagccccagcccaaatcctatttcaagagcatctctgtgaccaagatcactaaaccagatgggatagtggaggagcgccggactgtggtggacagtgagggccggacagagactacagtaacccgacacgaagcagatagcagtcctaggggtgatccagaatcaccaagacctccagccctggatgatgccttttccatcctggacttattcctgggacgttggttccggtcccggtagccttgttaaccctcagaggccttcaagtcctttccacctctcacccattgcccaccattaataagcttagcttctcttgccacctcaggggcttggatatgtggaatagtgaactggggccatgtcagtttgtcactcacccaaactgaccaataaaacctttatttatgctaaaaaaaaaaaaaaaaaaaaaaa

SEQ ID NO: 121 - DNA, 1542 bp, Homo sapiens
ggaagagtcttttcagcgctgaggactggcgctgaggaggcggcggtggctcccggggcgtttgagcgggctcacccgagcccgcgggccaacgcggatccaggcccgactggcgggaccgccccggattccccgcgggccttcctagccgccatggaggacggcgtctatgaacccccagacctgactccggaggagcggatggagctggagaacatccggcggcggaagcaggagctgctggtggagattcagcgcctgcgggaggagctcagtgaagccatgagcgaggtggaggggctggaggccaatgagggcagtaagaccttgcaacggaaccggaagatggcaatgggcaggaagaagttcaacatggaccccaagaaggggatccagttcttggtggagaatgaactgctgcagaacacacccgaggagatcgcccgcttcctgtacaagggcgaggggctgaacaagacagccatcggggactacctgggggagagggaagaactgaacctggcagtgctccatgcttttgtggatctgcatgagttcaccgacctcaatctggtgcaggccctcaggcagtttctatggagctttcgcctacccggagaggcccagaaaattgaccggatgatggaggccttcgcccagcgatactgcctgtgcaaccctggggttttccagtccacagacacgtgctatgtgctgtccttcgccgtcatcatgctcaacaccagtctccacaatcccaatgtccgggacaagccgggcctggagcgctttgtggccatgaaccggggcatcaacgagggcggggacctgcctgaggagctgctcaggaacctgtacgacagcatccgaaatgagcccttcaagattcctgaggatgacgggaatgacctgacccacaccttcttcaacccggaccgggagggctggctcctgaagctggggggccgggtgaagacgtggaagcggcgctggtttatcctcacagacaactgcctctactactttgagtacaccacggacaaggagccccgaggaatcatcccccaggagaatctgagcatccgagaggtggacgacccccggaaaccgaactgctttgaactttacatccccaacaacaaggggcagctcatcaaagcctgcaaaactgaggcggacggccgagtggtggagggaaaccacatggtgtaccggatctcggcccccacgcaggaggagaaggacgagtggatcaagtccatccaggcggctgtgagtgtggaccccttctatgagatgctggcagcgagaaagaagcggatttcagtcaagaagaagcaggagcagccctgaccccctgcccccaactccattatttattacggagctgccccgcctgggtggccggacccctgggccttggggctgtggatcctggttccctgtttggaaaattcaccacctctagctcctcactgttctttgtaattaacacgctgttggtaatcttattaattatttaaccacttggaaaaaaaaaaa

SEQ ID NO: 122 - DNA, 641 bp, Homo sapiens
acttcctctccagcccctgcgtaatcgataaggaaacccggacgctgctgcccctttctttttttcaggcggccgggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccaaaaaaaaaaaaaaaaaaaaaaaaaaaaaaaa

SEQ ID NO: 123 - DNA, 6744 bp, Homo sapiens
ggacctcgcaggccaagaattcggcacgaggggcgccggctcccggggcacggacggccgggcgcgcgcctctgcgaggggcgtccgggtccgagtcggcggtccgggccggcgcgaggtgcgtgcgggcgggccgcgggggtcccggacggacacaagcgcacacactcccggaagatcgcttaccctccgggggtaaaagagatcaccgacaagatcaccacggacgagatgatcaaacgcctgaagatggtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggacatatttttgtttattaccagacaattaaaaggtttggaggatacaaagagtccacagtttaatagatacttttatttattagagaatttagcttgggttaaatcatataacatctgctttgaattggaagattgcaatgaaatttttattcagctttttagaactctcttctcagtgatcaacaatagccacaataagaaggtacaaatgcacatgctagatttgatgagttctatcatcatggaaggtgatggagttactcaagaattattgggctccattcttattaacctcattcctgcacataagaacttaaataaacagtcctttgaccttgcaaaagtgctattgaaaagaacagtccagactattgaggcatgcattgccaattttttcaatcaagtcctggtgctgggaagatcatcagtaagtgatttgtcagaacatgtatttgatctgattcaggaactttttgctatagatcctcatttattattatccgtcatgccacagcttgaattcaaactaaagagcaatgatggagaagagcgattagctgttgttcgacttctagctaaattgtttggctccaaagattctgatttggcaacacagaatcgtcctctttggcaatgttttcttggacgatttaatgatattcatgttcctgtgagattagaaagtgtgaaatttgccagtcattgtttaatgaatcacccagatttagcgaaggatctcacagaatatttaaaggttagatcacatgatccagaagaagctattcgtcatgatgtcattgttactataataacagctgccaagagggacctggccttagtaaatgatcagctgcttggctttgtaagggaaagaacactggataaacggtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaaactgttggtagagaaaatctttgctcagtatcttgtcccccacaacctggaaacagaagagagaatgaaatgcttatattacttatatgctagtttggatccaaatgctgtaaaagctctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtgagagaaatagcccggaaacttgcaaatcctaagcaaccaacaaatccttttctagagatggtcaaatttctgttggaaagaatcgcacctgtgcacattgattcagaagccataagtgcactagtgaaattgatgaataagtcaatagaggggacagcagatgatgaagaggagggtgtaagtccagatacagctatccgttcaggacttgaacttcttaaggttctgtcttttacacatcctacctcgttccactctgcagagacatatgagtccttgttacagtgcctaagaatggaggatgacaaggtagcagaagctgctattcaaatttttagaaatacaggtcacaaaatagaaacagaccttccccagatacgatcgaccttaattcccattttacatcaaaaagcaaagaggggtactccacaccaagcaaaacaggctgtgcactgtatacacgccatattcacaaataaagaagtccagcttgcacagatttttgagccactcagtaggagtctgaatgctgatgtgccagaacaacttataactccattagtttcattgggccacatttctatgttagcaccagatcagtttgcttccccaatgaaatctgtagtagcaaattttattgtgaaagatctgctaatgaatgacaggtcaacaggtgaaaagaatggaaaactgtggtctccagatgaagaggtttcccctgaagtactagcaaaggtacaggcaattaaacttctggtaaggtggctgttgggtatgaaaaacaaccagtctaaatctgccaattcaacccttcggttattatcagcgatgttggttagtgagggtgacctgacagagcaaaagaggatcagtaaatctgatatgtctcgcttgcgattagctgctggtagtgccataatgaagcttgctcaggaaccttgttaccatgaaattattaccccagaacagtttcagctctgtgcacttgttattaatgatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactgagaaattattatcactgttgcctgaatatgtagttccatacatgattcacctgctagcccatgatccagattttacaagatcacaagatgttgatcagcttcgtgatatcaaagagtgcctatggttcatgcttgaagttttaatgacaaagaatgaaaacaatagccatgcctttatgaagaagatggcagagaacatcaagttaaccagagatgcccagtctccagatgaatccaagacaaatgaaaaactgtatacagtatgtgatgtggctctctgtgttataaatagtaaaagtgctttgtgcaatgcagattcaccaaaggacccagtcctcccaatgaaattttttacacaacctgaaaaggacttctgtaacgataagagttatatttcagaagagacaagagtacttctgttaacaggaaagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaagggaacagagttcagaggcagcagaaactggagttagtgaaaatgaagagaaccctgtgaggattatttcagtcacacctgtaaagaatattgacccagtaaagaataaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagatgatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcatt

SEQ ID NO: 124 - DNA, 1039 bp, Homo sapiens
atggggaggtcctccatgcgcagtcatgagtcgcttcaagtttatcgatattggtatcaacttgactgaccctatgttcagaggaatttataggggggttcaaaagcatcaagatgacttacaggatgtaatagggagagctgtcgagattggtgttaaaaagtttatgattacaggtggaaatctacaagacagtaaagatgcactgcatttggcacaaacaaatggtatgtttttcagtacagttggatgtcatcctacaagatgtggtgaatttgaaaagaataaccctgatctttacttaaaggagttgctaaatcttgctgaaaacaataaagggaaagttgtggcaataggagaatgcggacttgattttgaccgactgcagttttgtcccaaagatactcaactcaaatattttgaaaaacagtttgaactgtcagaacaaacaaaattaccaatgtttcttcattgtcgaaactcacatgctgaatttttggacataatgaaaagaaatagagatcggtgtgtagggggagtggtgcattcatttgatggtaccaaggaagcagcagctgctttgattgacttggatctttatataggatttaatggttgctcactgaaaactgaagctaatttggaagttttgaagtcaattcctagtgaaaaattaatgattgagacagatgcaccttggtgtggagtcaaaagtacacatgctggatcaaaatatataagaactgcatttcctaccaaaaagaagtgggaaagtgggcactgcttaaaagacagaaatgaaccctgccatataattcaaatattggagataatgtcagcagtgagagatgaggatccactggaattagccaatacactatataacaatactattaaagtattttttcctggaatataattggtatatgtcttccactttccatcatgtatgtaaaatttcatagtaaaacttcctgatagtttcaataaagaaattatctgcaaaaaaaaaaaaaaaaaaaaaaaaaaaaaaaaaaaa

SEQ ID NO: 125 - DNA, 4562 bp, Homo sapiens
agtggcgcggccggctgggtggcccgcgagctgcacccggatctgctccgcgggggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcattggtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctatccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaaaaaaaaaaaaaaaa

SEQ ID NO: 126 - DNA, 6104 bp, Homo sapiens
agatgggcactctcgggtcatatctctagacctggggcttcacggaggccggggcgactacggacgccctagacttcgggcccctcagccccgtcaagcagagggaggcactttcacccggccagcaaccttctccctccgttctccagcagcgaggagggaactccaccgcaggtcacttctgcggcctgggagctggcgcccggccaccccccacagcctccaacctacggcgtagacgtcgccactctgcagccttcctcacagttacagccgcccccgctgccggctcctcacctctttgggcctcgccatcttggcaccgccccgcggcaacgtcacgtgacgaaatccccgcccacgctccgggtccgggggcgagcggtcacgtgggcatggcgtctgggggcggggttagggcgagcgggcgcgcgaagatggcggcggccgccggcgggccgtgtgtgaggagcagtagagaactgtggactattctgcttggaaggtcagctctgagagagctgagtcagattgaggcagaactgaataaacattggcggcgattgttagaggggctttcttactacaaacctcccagtccaagttcagctgaaaaagtgaaagctaataaagatgtagcttcaccattgaaggaactgggtttaagaatcagcaagtttttgggtcttgatgaagaacagagtgtgcagttactccagtgttacctgcaagaggactacaggggtactcgggactcagtaaagacagtactgcaagatgagaggcagagccaggccttaatcctgaagattgcagattattattatgaagaaagaacctgtattcttcgttgtgtcttacaccttctcacttacttccaagatgaaagacacccctatagggttgaatatgcagactgtgttgataaattggagaaggaactagtttcaaaatacagacagcagttcgaagagctttataaaactgaagcaccaacttgggagacacatggaaatctcatgacagagcgccaagtgtctcgctggtttgttcagtgccttcgggaacagtccatgctgctagaaattattttcctttattatgcatactttgagatggcacccagtgacttacttgtattaaccaagatgtttaaagagcaaggatttggtagtaggcagaccaataggcacctggtggatgagactatggatccttttgtagatcggattggctacttcagtgccctcatcctggtggagggcatggatatcgagtccttgcataagtgtgctttggatgacagaagagaactgcatcagtttgcgcaggatgggcttatttgtcaggatatggactgtttaatgttgacctttggggacattccacatcatgccccagtgcttttggcctgggctctcctccgtcacactctgaacccagaagagacaagcagtgtggtccggaagataggtggcacagccatccagctgaatgtgtttcagtacttgacccgattgctccagtcccttgccagtgggggaaatgattgcaccaccagcactgcatgcatgtgtgtctatggactgctctctttcgttctgacctcgttggagctgcacaccctgggcaatcagcaggatataattgatacagcatgtgaagtattggccgacccttctcttccggaactgttctggggaacagagccaacttctggccttgggatcattctggacagtgtgtgtggaatgtttccccaccttctctccccactcctgcaactgctccgagccctggtatcagggaagtccacagccaaaaaggtgtatagcttcttggataagatgtctttctacaatgaactttataaacacaagcctcatgatgtgatctcccatgaagatggaactctttggcggagacaaacacccaaactcctttatccccttgggggtcaaaccaaccttcgcatacctcaaggcactgtgggccaagtaatgttggatgatagggcatacctggtacgctgggaatactcctatagcagctggaccctctttacctgcgagattgaaatgttgcttcatgttgtttcaactgcagatgtgattcagcactgccagcgagtcaaacccatcattgatctcgtccataaggtcatcagtacagacctgtcgatagcagactgtctcctgcccatcacatctcgcatctacatgctgctgcagcggttaacgacagtgatctccccacctgtggatgtcattgcttcttgtgtcaactgcttaactgttttggctgcccgcaatccagcaaaggtctggactgatcttcgtcacacaggttttttaccatttgtggcccatcctgtctccagcctgagtcagatgattagtgcggaagggatgaatgctggagggtacggaaacctcttgatgaacagtgaacagcctcagggcgagtatggggttactattgcctttctgcgcttgatcaccacccttgtcaaggggcaacttggtagtacccagagccaaggacttgtaccctgtgtaatgtttgtgctgaaggagatgcttcccagctaccataagtggcgctacaactctcatggagtgagggaacagattggttgcctgatcttggagctgattcatgcgatactgaacctgtgccacgagacagacctgcacagcagtcatactcccagcctgcagtttctctgcatctgcagcctggcatacacagaagcaggacagacagttatcaatatcatgggcattggcgtggacaccattgacatggtgatggctgctcagcctcgaagtgatggggcagagggccaggggcagggccagctgctgatcaagacagtgaaactggcattctccgtcaccaacaatgttattcggctgaaacctccttctaatgtggtgtcccccctggaacaggctctctcacaacatggtgctcatggaaacaacctcattgctgttctagccaaatacatctaccacaaacatgaccctgctttgccacgtcttgccattcagctgctgaaacgtctggccacggtggccccaatgtcagtgtatgcttgtctgggcaatgatgcggctgccattcgtgatgccttcctgacccgattgcagagcaaaattgaggacatgcgcatcaaagtcatgattctagagttcctcactgttgcagtagagacccagccaggcctcatcgaactgtttctgaacctggaagttaaggatggcagtgatggctcaaaggaattcagccttgggatgtggagctgtctccatgcagtgctggagctgattgattcccaacagcaagatcgatactggtgcccacccctgctgcatcgtgccgccattgcctttttgcatgctctgtggcaggatcggagggacagtgccatgctggtcctccgaaccaaacccaagttttgggaaaatttaaccagtccgctgtttggaaccctttctcctccctctgaaacatcagagcccagcatcctggaaacctgtgccctaatcatgaagataatttgcttggagatatactatgtagtaaagggttcattagaccagtcattaaaggatacactgaagaaattttccatcgagaaacgctttgcctactggtcagggtatgtcaagtcattggcagttcacgtggccgaaacagaaggcagcagctgcacctccttgttagagtaccagatgctggtgtccgcctggaggatgcttctcatcattgccaccactcatgcagatataatgcacctgactgactctgtggtgcgtcgccagctctttcttgacgtgcttgatggaaccaaagcattactcctagttccagcctcagtgaactgccttcgccttggctccatgaagtgcactctgctgcttatcctcctccggcagtggaagagagagttaggttctgtggatgaaatccttggacccttgacggagatcctggagggagtgctgcaggccgaccagcaactcatggagaagaccaaggccaaggtgttctcagcattcatcacagtgttgcaaatgaaggagatgaaagtaagtgacatcccccagtactcccagctggtgctgaatgtctgtgagaccctccaagaggaagtgattgcactcttcgaccagacccgccacagtctggcattaggcagtgccacagaggacaaggacagcatggagactgacgactgttctcggtcccggcacagggaccagcgtgatggggtgtgtgtcctgggcctgcacctggccaaggagctgtgtgaggtagacgaggatggtgactcctggctgcaggtaacccgcaggctccccatcctacccaccctcctcaccactctagaggtgagccttcgcatgaagcagaacctgcatttcactgaggccacattgcatctgctcctcaccctggctcgcactcagcagggagccacagcagtggctggagctggcatcacccagagcatttgtttgccccttctgagtgtgtaccagctgagcaccaacggcacagcacagacacctagtgcctctcggaagtccctggatgccccctcttggccaggagtctaccgcctgtccatgtccctgatggagcagctgctcaaaactctgcgctacaacttcctgcctgaggccctggacttcgtgggtgtccaccaggagcggaccttacagtgcctcaacgcagtgaggacagtgcagagtctggcctgcctggaggaggcggaccacaccgtgggttttattctgcagctctctaacttcatgaaggagtggcacttccacctgcctcagctcatgcgtgatatccaggtcaacctgggttacttgtgccaggcatgtacctctctcctgcacagtcgaaagatgctgcagcattacttacagaacaaaaatggggatggcctcccctcagctgttgcccagcgagtccagaggccaccgtctgctgcttctgctgccccctcctcctcaaagcagcccgctgctgacacagaggcatcagagcagcaggccttgcacacagtccagtatggccttctcaagatcctcagcaagacgctggcagccctgcgccacttcaccccagatgtctgccagattctgctggatcagtccctggaccttgctgaatacaacttcctgtttgccctgagctttaccactcccacctttgactccgaagtggccccctccttcgggacccttctggccacagtgaatgtggccctcaacatgcttggagagctggacaagaaaaaggagcccctcacccaggcagtggggctcagcacacaggcagaagggaccaggacgttaaagtccctcctgatgtttaccatggaaaactgcttctacctgctcatctctcaggcgatgcggtaccttagggacccggctgtgcacccccgggacaaacagcggatgaagcaggagctcagctctgagttgagcacgctgctgtccagcctctcgcgctacttccgccggggagcccccagctcccctgccactggtgtcctcccctcgccgcagggcaagtccacctctctctccaaagccagccctgagagtcaggagcctctgatccagttggtgcaggcgtttgtccggcatatgcaaagatagggcagtgctgttctgcccacctacccctctccaccagcctacactgcaccctggctggcaggggtgctgctggctgctagggcctatacaatggagggcacctcctgtcacccccctcccggagtagccacgactccagccaccacccactgacgttatttttatactagatgaagaggtcaacagcaggcatggggagccgagtcttctgtgctcaggtcctcacgctgcagacgccccctagaggaactttccttcctttccagcattccccacagcactgccggccaggggagaggcggcagcccagcagagggctctatgcacgggtttcaaacctgttttccacactctgtctttgcagttttggtaattctgtggtctatttatacagatattaaaatcttgtttatagac

SEQ ID NO: 127 - DNA, 1370 bp, Homo sapiens
ggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtg

SEQ ID NO: 128 - DNA, 1115 bp, Homo sapiens
agaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgcagtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgt

SEQ ID NO: 129 - DNA, 6139 bp, Homo sapiens
ggcaccaggtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaagatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggatcccagcggaggggggtcacaacaacgaccccgcccaccaagcacccccactacaagaactcctccagcagcatagattagacgtgatccactttgctttcttgcttctcacctcgcccccttgcacattgcatgacaccctcatattgggcagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttaaaaaaaaaaaaaaaaaaaaaaaaaaaaaaaaaaaaaaaaaaaaaaaaaaaaaaaaaaaaaaaaaaaaaaaaaaa

SEQ ID NO: 130 - DNA, 6449 bp, Homo sapiens
aattctaaggaaaacctggaagcacaatgggagatgacagtgagtggttgaaactgccagttgatcagaaatgtgaacacaagctgtggaaagcaaggttaagtgggtatgaagaggccctgaagatcttccagaaaataaaggatgaaaagagcccagagtggtccaaatttttaggattgatcaaaaaatttgtcactgattccaatgcagtggttcaattgaaaggattagaagctgcacttgtttatgttgaaaatgcccatgtagcaggaaaaaccacaggagaagttgtgtcaggtgttgtaagtaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataaaaaaccccaaactggaagctggcgattatgcagatttagtaaaagcattaaagaaggttgttggaaaggacaccaatgtcatgttggtggctttggcagcaaaatgtcttactggcctggctgttgggctaaggaagaaatttggacaatatgcaggacatgttgtgccaaccatcttggagaaattcaaagagaagaaacctcaagtggtacaagccctgcaggaggcaattgatgcaatcttccttactaccacactacagaacatcagtgaggatgttttagcagtaatggataataaaaatccaaccatcaagcagcagacatctctttttattgcaagaagtttccgccactgcactgcttctaccctgccaaagagcttgctaaagcccttttgtgctgcactacttaagcacatcaatgattctgctcctgaagtcagagatgccgcatttgaagcattgggtactgctttgaaggtggttggcgagaaagcagtaaaaccattcctagctgatgtggacaaactcaagcttgataagatcaaagaatgttcagaaaaggtagaactgatacatggtaagaaagctggactagctgctgataagaaggaattcaaacctctgcctggaaggactgctgcttcaggggctgcaggagataaggacacaaaggacatttctgcacccaaaccaggacctctaaaaaaggcacctgctgctaaggctggtgggccaccaaaaaaggggaaaccagctgcaccaggaggcgcagggaatactggaaccaagaacaagaaaggactggagactaaagaaatagtggagcctgagctctcgatagaagtatgcgaagaaaaagcttcagctgttcttccccctacctgtatacagcttcttgacagcagtaactggaaagaaaggctggcttgtatggaagagttccagaaggctgttgagctaatggaccgaactgaaatgccatgccaggcattagtgaggatgctagccaagaaacctggatggaaagaaactaattttcaggtgatgcaaatgaagcttcatatagttgctttgattgcccagaagggaaatttttccaaaacgtcagctcaggttgtattagatggccttgtggacaagattggagatgtgaaatgtgggaacaatgcaaaagaagctatgacagcaatagccgaagcctgtatgttaccatggactgctgaacaggttgtgtcaatggctttctcacaaaagaatcccaaaaatcagtcagaaactctgaattggctatcaaatgccataaaagaatttggtttttctgggttgaatgtcaaagctttcattagcaatgtgaagacagctcttgctgcaacaaacccagctgtgaggactgctgccataaccctgcttggcgtgatgtatctgtatgttggtccctctttgcgaatgttctttgaggatgagaagcctgccctcctatcccagatagatgcagaatttgagaagatgcagggacaaagtccacctgctccaaccagaggaatttccaagcatagcacaagtggtacagatgaaggagaagatggagatgaaccagatgacgggagcaatgatgtcgttgatcttttgccgaggacggagatcagtgataaaatcacttcagagttggtatctaagattggtgataagaattggaagattaggaaagaaggcctagatgaagtggcaggtattattaatgacgcaaaatttatccaaccgaatataggtgaacttccaactgccttgaagggtcgactcaatgattcaaataaaatcttggtacagcaaacgctgaatatcctgcaacaactggcagtagccatgggcccaaatattaagcaacatgtaaaaaatttaggcatccctatcatcacagtccttggagacagcaagaacaatgttcgagctgctgccctagcgactgtgaatgcttgggcagaacagactggcatgaaggaatggctggaaggagaagatctttctgaagagctcaaaaaggaaaatcctttcttgaggcaagagcttctgggctggctggctgagaaactacctactcttcgttccacccctacagaccttatcctttgtgttcctcatctctactcctgcctagaagatcgaaatggagatgtgcgaaagaaggcccaagatgccttgccattcttcatgatgcatttaggatatgaaaaaatggccaaggctactgggaaactaaagccaacttctaaagatcaggtattggccatgctagagaaagccaaagttaacatgccagccaagcctgctccacccactaaagcaacttctaaaccaatgggagggtccgctccagccaaattccagcctgcatcagcacctgctgaagattgtatttccagcagtacagaacccaaacctgatccaaaaaaggccaaagctccaggattatcctctaaagcaaagagtgcacaagggaagaagatgccaagcaaaaccagcttaaaggaggatgaagacaaatccgggcctatttttattgttgttccaaatggaaaagagcaaaggatgaaagatgaaaaaggattgaaggtgctaaagtggaattttactaccccacgggatgaatacattgagcaactaaagactcaaatgtctagctgtgtggctaaatggttacaagatgagatgtttcactcagactttcagcatcataacaaagcccttgctgttatggttgatcacttggagagtgaaaaagaaggagttattggttgcctggatcttatcttaaagtggcttaccctgaggttttttgacaccaatacaagcgtcctgatgaaagcactagaatatttaaaattgctcttcaccttgctaagtgaagaagaatatcatcttactgagaatgaagcatcttccttcatcccctatcttgtcgtcaaggttggagaaccaaaggatgtcattcgtaaagatgttcgtgccatcctgaaccggatgtgccttgtctacccagctagcaagatgtttccctttatcatggaaggaaccaaatccaaaaactctaagcagagagcagagtgcctggaagagctgggatgtctggttgagtcctatggcatgaatgtttgccaaccaaccccaggaaaagccttaaaggaaatagctgttcacataggagaccgtgacaatgctgtacgcaatgctgcactcaacaccattgtaacggtgtacaatgtacatggggatcaggtgttcaaactgattggaaatctttctgaaaaggatatgagcatgctcgaggagaggattaagcggtcagcaaagagaccctctgctgcaccaataaaacaggtggaagagaaacctcagcgtgcacagaacataagctccaatgccaacatgttacgcaagggaccagctgaggacatgtcttccaaactcaaccaagcccgaagcatgagtgggcatcctgaggcagcccagatggtccgccgagaattccagctggatctagatgagattgagaatgacaatggtacagtccgatgtgaaatgccagaacttgttcagcacaaactggatgacatttttgagccagtccttattcctgaacccaagatccgggctgtttctccacacttcgatgacatgcacagtaatacagcatccacaatcaatttcattatctcccaagtagccagtggtgacatcaacacaagtatccaagctctgacacagctgtttcagatagagagccttgcccgggaggcctccactggagtactaaaagacctaatgcatggcctcatcaccttaatgctggattctcggattgaagatcttgaggaaggacaacaggtcatccgctctgtgaacctcttggtggtgaaggttctggagaagtcagaccagaccaacatcctgagtgccctacttgttttgctccaagacagcctgctagcaacagccagttctcccaaattctcagagcttgttatgaagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaagatcctggaccacctaacgatgatcgacaacaaaaacgagtctgagctggaggcccatctctgccggatgatgaagcacagtatggaccagactgggagcaagtctgataaggaaacagcaaagggagcatctcgaatagatgcaaaatcatcaaaggccaaagtgaatgatttcttagctgagatttttaagaagattggctctaaagaaaacactaaagagggactagcagagttatatgaatataagaagaaatactcagatgctgacattgaaccatttctgaaaaattcctcacagttcttccagagctatgtcgaaagaggccttcgggtgattgagatggagagggagggcaaaggtcgtatttccacttcaacaggcatctcccctcagatggaagtcacatgtgtgcccacgcccacaagcacagtgtcctccataggtaacacaaatggggaagaagtggggccatctgtctacttggaaaggctaaagatcctccgacagcgatgtggtctggacaacacaaagcaagatgaccgacctcctttgacctctttgctctccaaaccagcagttcctactgtcgcctcttccacagacatgctccacagcaaactctctcagctccgggagtcacgggagcagcaccagcattcagacctggattctaaccagactcactcttcaggaactgtgacctcctcctcctccacagctaacatagacgacttgaaaaaaagactggagagaataaagagcagtcgcaaatgaagctgccccactcccccggcaccctgcagctttagtttactaaactagaagtcctcatagtttaaaatggcctcagcaggcctagtgtatacaaactggttgtatgtatcatgccgtggagctagggggaggggtcattgtggcacaagtatttgtacatactctgcttctctctgtcagcgtcctgctgctctagaagactgtccgtggatgagtttagtgtacagacttgtaaacagctgccccctctctgctcagtctagttcccaggtccttttcttttctttttaattgctcatttgtaaaattgtcctaatctttcctagctttttaatagttaatattagaaactctttaatagttttcctttcagtttgtgagctcttctctgtcgccctgaagggtcactgtattctgtatgaatccatggcatgatacaactaatttaagagtcttttataaataaagtttgcattaactaaaaaaaaaaaaaaaaaaaaaaaa

SEQ ID NO: 131 - DNA, 2153 bp, Homo sapiens
gcacgaggcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccctttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggatgaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggttttcatcatgccttgtcttttttaactgagaaaggagattttttgaaaagagtacaattaaaaggacattgtcaaaaaaaaaaaaaaaaaaa

SEQ ID NO: 132 - DNA, 5434 bp, Homo sapiens
atggggcagcagcctggaaaagtacttggggaccaaagaaggccaagcttgcctgccctgcattttatcaaaggagcagggaagaaggaatcatcgaggcatgggggtccacactgcaatgtttttgtggaacaagcccttcagcggccagtagcatctgactttgagcctcagggtctgagtgaagccgctcgttggaactccaaggaaaaccttctcgctggacccagtgaaaatgaccccaaccttttcgttgcactgtatgattttgtggccagtggagataacactctaagcataactaaaggtgaaaagctccgggtcttaggctataatcacaatggggaatggtgtgaagcccaaaccaaaaatggccaaggctgggtcccaagcaactacatcacgccagtcaacagtctggagaaacactcctggtaccatgggcctgtgtcccgcaatgccgctgagtatccgctgagcagcgggatcaatggcagcttcttggtgcgtgagagtgagagcagtcctagccagaggtccatctcgctgagatacgaagggagggtgtaccattacaggatcaacactgcttctgatggcaagctctacgtctcctccgagagccgcttcaacaccctggccgagttggttcatcatcattcaacggtggccgacgggctcatcaccacgctccattatccagccccaaagcgcaacaagcccactgtctatggtgtgtcccccaactacgacaagtgggagatggaacgcacggacatcaccatgaagcacaagctgggcgggggccagtacggggaggtgtacgagggcgtgtggaagaaatacagcctgacggtggccgtgaagaccttgaaggaggacaccatggaggtggaagagttcttgaaagaagctgcagtcatgaaagagatcaaacaccctaacctagtgcagctccttggggtctgcacccgggagcccccgttctatatcatcactgagttcatgacctacgggaacctcctggactacctgagggagtgcaaccggcaggaggtgaacgccgtggtgctgctgtacatggccactcagatctcgtcagccatggagtacctagagaagaaaaacttcatccacagagatcttgctgcccgaaactgcctggtaggggagaaccacttggtgaaggtagctgattttggcctgagcaggttgatgacaggggacacctacacagcccatgctggagccaagttccccatcaaatggactgcacccgagagcctggcctacaacaagttctccatcaagtccgacgtctgggcatttggagtattgctttgggaaattgctacctatggcatgtccccttacccgggaattgaccgttcccaggtgtatgagctgctagagaaggactaccgcatgaagcgcccagaaggctgcccagagaaggtctatgaactcatgcgagcatgttggcagtggaatccctctgaccggccctcctttgctgaaatccaccaagcctttgaaacaatgttccaggaatccagtatctcagacgaagtggaaaaggagctggggaaacaaggcgtccgtggggctgtgactaccttgctgcaggccccagagctgcccaccaagacgaggacctccaggagagctgcagagcacagagacaccactgacgtgcctgagatgcctcactccaagggccagggagagagcgatcctctggaccatgagcctgccgtgtctccattgctccctcgaaaagagcgaggtcccccggagggcggcctgaatgaagatgagcgccttctccccaaagacaaaaagaccaacttgttcagcgccttgatcaagaagaagaagaagacagccccaacccctcccaaacgcagcagctccttccgggagatggacggccagccggagcgcagaggggccggcgaggaagagggccgagacatcagcaacggggcactggctttcacccccttggacacagctgacccagccaagtccccaaagcccagcaatggggctggggtccccaatggagccctccgggagtccgggggctcaggcttccggtctccccacctgtggaagaagtccagcacgctgaccagcagccgcctagccaccggcgaggaggagggcggtggcagctccagcaagcgcttcctgcgctcttgctccgtctcctgcgttccccatggggccaaggacacggagtggaggtcagtcacgctgcctcgggacttgcagtccacgggaagacagtttgactcgtccacatttggagggcacaaaagtgagaagccggctctgcctcggaagagggcaggggagaacaggtctgaccaggtgacccgaggcacagtaacgcctccccccaggctggtgaaaaagaatgaggaagctgctgatgaggtcttcaaagacatcatggagtccagcccgggctccagcccgcccaacctgactccaaaacccctccggcggcaggtcaccgtggcccctgcctcgggcctcccccacaaggaagaagcctggaaaggcagtgccttagggacccctgctgcagctgagccagtgacccccaccagcaaagcaggctcaggtgcaccaaggggcaccagcaagggccccgccgaggagtccagagtgaggaggcacaagcactcctctgagtcgccagggagggacaaggggaaattgtccaagctcaaacctgccccgccgcccccaccagcagcctctgcagggaaggctggaggaaagccctcgcagaggcccggccaggaggctgccggggaggcagtcttgggcgcaaagacaaaagccacgagtctggttgatgctgtgaacagtgacgctgccaagcccagccagccggcagagggcctcaaaaagcccgtgctcccggccactccaaagccacaccccgccaagccgtcggggacccccatcagcccagcccccgttcccctttccacgttgccatcagcatcctcggccttggcaggggaccagccgtcttccactgccttcatccctctcatatcaacccgagtgtctcttcggaaaacccgccagcctccagagcgggccagcggcgccatcaccaagggcgtggtcttggacagcaccgaggcgctgtgcctcgccatctctgggaactccgagcagatggccagccacagcgcagtgctggaggccggcaaaaacctctacacgttctgcgtgagctatgtggattccatccagcaaatgaggaacaagtttgccttccgagaggccatcaacaaactggagaataatctccgggagcttcagatctgcccggcgtcagcaggcagtggtccggcggccactcaggacttcagcaagctcctcagttcggtgaaggaaatcagtgacatagtgcagaggtagcagcagtcaggggtcaggtgtcaggcccgtcggagctgcctgcagcacatgcgggctcgcccatacccatgacagtggctgagaagggactagtgagtcagcaccttggcccaggagctctgcgccaggcagagctgagggccctgtggagtccagctctactacctacgtttgcaccgcctgccctcccgcaccttcctcctccccgctccgtctctgtcctcgaattttatctgtggagttcctgctccgtggactgcagtcggcatgccaggacccgccagccccgctcccacctagtgccccagactgagctctccaggccaggtgggaacggctgatgtggactgtctttttcatttttttctctctggagcccctcctcccccggctgggcctccttcttccacttctccaagaatggaagcctgaactgaggccttgtgtgtcaggccctctgcctgcactccctggccttgcccgtcgtgtgctgaagacatgtttcaagaaccgccatttcgggaagggcatgcacgggccatgcacacggctggtcactctgccctctgctgctgcccggggtggggtgcactcgccatttcctcacgtgcaggacagctcttgatttgggtggaaaacagggtgctaaagccaaccagcctttgggtcctgggcaggtgggagctgaaaaggatcgaggcatggggcatgtcctttccatctgtccacatccccagagcccagctcttgctctcttgtgacgtgcactgtgaatcctggcaagaaagcttgagtctcaagggtggcaggtcactgtcactgccgacatccctcccccagcagaatggaggcaggggacaagggaggcagtggctagtggggtgaacagctggtgccaaatagccccagactgggcccaggcaggtctgcaagggcccagagtgaaccgtcctttcacacatctgggtgccctgaagggcccttcccctcccccactcctctaagacaaagtagattcttacaaggccctttcctttggaacaagacagccttcacttttctgagttcttgaagcatttcaaagccctgcctctgtgtagccgccctgagagagaatagagctgccactgggcacctcgcgacaggtgggaggaaagggcctgcgcagtcctggtcctggctgcactcttgaactgggcgaatgtcttatttaattaccgtgagtgacatagcctcatgttctgtgggggtcatcagggagggttaggaaaaccacaaacggagcccctgaaagcctcacgtatttcacagagcacgcctgccatcttctccccgaggctgccccaggccggagcccagataccggcgggctgtgactctgggcagggacccggggtctcctggaccttgacagagcagctaactccgagagcagtgggcaggtggccgcccctgaggcttcacgccggagaagccaccttcccgccccttcataccgcctcgtgccagcagcctcgcacaggccctagctttacgctcatcacctaaacttgtactttatttttctgatagaaatggtttcctctggatcgttttatgcggttcttacagcacatcacctctttccccccgacggctgtgacgcagcggagaggcactagtcaccgacagcggccttgaagacagagcaaagcccccacccaggtcccccgactgcctgtctccatgaggtactggtcccttccttttgttaacgtgatgtgccactatattttacacgtatctcttggtatgcatcttttatagacgctcttttctaagtggcgtgtgcatagcgtcctgccctgccctcgggggcctgtggtggctccccctctgcttctcggggtccagtgcattttgtttctgtatatgattctctgtggttttttttgaatccaaatctgtcctctgtagtattttttaaataaatcagtgtttacattag

SEQ ID NO: 133 - DNA, 1977 bp, Homo sapiens
gcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtttattggaacaaagggtggtaccaaaatgcatccccatgacccacagcccccccacacccgtccttgggtagggtacggtggggtggggtgttgggtggcctgctgctcctgttgctttcacgtagagtctcggcctgggcagtcacgtggtggtcactcctggatgtgctgtcctatccagcctctcacagctgccacccgggtatagacacctgggaagtggggccggccacagccatagccccagctagtgaccccagttagcacccaccgtccagagggctccctgcaggccaggggtcccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagccaaaaaggcaaaaaaaaaaaaaaaaaaaaa

SEQ ID NO: 134 - DNA, 2208 bp, Homo sapiens
gaggaagaggtggcggcggtggcggtggtcgtagcggtggcggaggaggcgggtacgaatcagctgcgggcggagacatggccaacatcgcggtgcagcgaatcaagcgggagttcaaggaggtgctgaagagcgaggagacgagcaaaaatcaaattaaagtagatcttgtagatgagaattttacagaattaagaggagaaatagcaggacctccagacacaccatatgaaggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttttagtgatgaaatttttctttgagaactggcaaggatgcagtcagctgtttgcagtttttagcctgattttggggtctatagagattgctttattggatacttcaagtcattcttgcttgcacttcccctattgacacatgaaagctgtgttggtgttttattgtacatacttcagatgcacataggaatagaagtgtgttataaatctagctttctttatgatgtttctgataatacgagaattgaaaactttaccttctcttgtacatagtcagactatttgtattaaatttacatttcattctaagttcaaaagtttgaaaattattagttttgcaagatcacacactaatgtaaccattttatgaaggttgaagtggatttatgcaggcagttctatatatagaaatacaattctttttaaatttttaggaccaatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttg

SEQ ID NO: 135 - DNA, 1037 bp, Homo sapiens
gcgtcccggaagcgcccgcggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctacctt

SEQ ID NO: 136 - DNA, 1113 bp, Homo sapiens
gacgcatttccggttcccttcgtttaggtcggctggaaattatgtcctccgtcggttttccgcagtttttccaccaagcgagatatttttgggagttattccctaaataactgcattatatgctcctttcatgacgaaattgctgccgtggagaagactggaggaaactcgaggaagagggagaagccgacaagtgctcgacgggctaggaactgtcctgcttgggtgttagcgtttcccgccgggccagtaaggctgagtgacccggcgtggctactaggagaaggacgtacggtcctgctagtagaggaatatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacattgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtacacacaagaagaaatagacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtatagtccttcaataggaaattgtaattaaaatataattttatagaaccatttttatgtaatctgatttgaatgttatagttgataataataaaatcacttacttggttgactaaaa

SEQ ID NO: 137 - DNA, 2577 bp, Homo sapiens
cacatgtcggcgcaggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtctttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctccctttgctctgctggaagctggagggtgctaggcccctgtgtagtagtgtatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaaggggtggggtttgagatgtttgggtgggttagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttgggtttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcacttttgcaggatgacctcagggctatgtggattgagtaatgggatttgaatcaatgtattaatatctccatagctgggaaacgtgggttcaatttgccattggtttctgaaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctctctaaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagatttaaaaaaaaaaaaaaa

SEQ ID NO: 138 - DNA, 2327 bp, Homo sapiens
cgggggtgacagcagcccggagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccctggtaccacggcctcctgtcccgccagaaggctgaagctcttcttcagcaagatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatgtaaaaaaaaaaaaaaaa

SEQ ID NO: 139 - DNA, 1620 bp, Homo sapiens
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 140 - DNA, 855 bp, Homo sapiens
gcctgcgcggtagtgggacccgaccctgtctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtacccaaccctctgggatagatgcaggaagcgatggttaagacccattttcacccaacttctcgccgcaggtctggcttaccacacgctcctccccattcccagtgagccgctttttgcagcaccaggcgaacacttacaccagtgctttgtaaaggaatcttattgtccaccccgtgtcttggcaaaagaacagtgatcacacagattcctacttgggctctttcctttaatcttcggaggctgagtttgcccaactcaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtcttaaagtttctgagtcctaattttggcaaaataaataacttatggtaatctggaattgtattttgtaatattaagtgttttgaacctctaacatttacttcccaaaatcaaacttcagtttcaaaat

SEQ ID NO: 141 - DNA, 4929 bp, Homo sapiens
acaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattatatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacagatgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcgcaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggattcttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattaggaaaaaaaaaaaaaa

SEQ ID NO: 142 - DNA, 1824 bp, Homo sapiens
cagctctctgtcagaatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctctgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacgggctcccggagcgtgtggagctggcacccctgcctccttggcagccggtgggccagaacttcaccctgcgctgccaagtggagggtgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtcctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaactccctaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 143 - DNA, 3186 bp, Homo sapiens
agttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagc

SEQ ID NO: 144 - DNA, 1488 bp, Homo sapiens
gttggtgagcatcatggcaaccgttacagccacaaccaaagtcccggagatccgtgatgtaacaaggattgagcgaatcggtgcccactcccacatccggggactggggctggacgatgccttggagcctcggcaggcttcgcaaggcatggtgggtcagctggcggcacggcgggcggctggcgtggtgctggagatgatccgggaagggaagattgccggtcgggcagtccttattgctggccagccgggcacggggaagacggccatcgccatgggcatggcgcaggccctgggccctgacacgccattcacagccatcgccggcagtgaaatcttctccctggagatgagcaagaccgaggcgctgacgcaggccttccggcggtccatcggcgttcgcatcaaggaggagacggagatcatcgaaggggaggtggtggagatccagattgatcgaccagcaacagggacgggctccaaggtgggcaaactgaccctcaagaccacagagatggagaccatctacgacctgggcaccaagatgattgagtccctgaccaaggacaaggtccaggccggggacgtgatcaccatcgacaaggcgacgggcaagatctccaagctgggccgctccttcacacgcgcccgcgactacgacgctatgggctcccagaccaagttcgtgcagtgcccagatggggagctccagaaacgcaaggaggtggtgcacaccgtgtccctgcacgagatcgacgtcatcaactctcgcacccagggcttcctggcgctcttctcaggtgacacaggggagatcaagtcagaagtccgtgagcagatcaatgccaaggtggctgagtggcgcgaggagggcaaggcggagatcatccctggagtgctgttcatcgacgaggtccacatgctggacatcgagagcttctccttcctcaaccgggccctggagagtgacatggcgcctgtcctgatcatggccaccaaccgtggcatcacgcgaatccggggcaccagctaccagagccctcacggcatccccatagacctgctggaccggctgcttatcgtctccaccaccccctacagcgagaaagacacgaagcagatcctccgcatccggtgcgaggaagaagatgtggagatgagtgaggacgcctacacggtgctgacccgcatcgggctggagacgtcactgcgctacgccatccagctcatcacagctgccagcttggtgtgccggaaacgcaagggtacagaagtgcaggtggatgacatcaagcgggtctactcactcttcctggacgagtcccgctccacgcagtacatgaaggagtaccaggacgccttcctcttcaacgaactcaaaggcgagaccatggacacctcctgagttggatgtcatcccccgaccccaccctgttttccaccagagttctgacactgtgactctgtataaaatggttgggaagctgc

SEQ ID NO: 145 - DNA, 1212 bp, Homo sapiens
gggtacaggaaagaagccagtgccccaggtcacctaagacaggcatcaagctcattcggcaaaatccagttgggttgttctaactggctcattcttacttgggtgacctctgcatggcaggagtaacttctgtgcctttgttttcatgttcagcgccatggatattgcaccctgggggaagctttcaacagactggacttctcaactgccattctggattccagaagatttaactacgtggtccggctgttggagctgatagcaaagtcacagctcacatccctgagtggcatcgcccaaaagaacttcatgaatattttggaaaaagtggtactgaaagtccttgaagaccagcaaaacattagactaataagggaactactccagaccctctacacatccttatgtacactggtccaaagagtcggcaagtctgtgctggtcgggaacattaacatgtgggtgtatcggatggagacgattctccactggcagcagcagctgaacaacattcagatcaccaggcctgccttcaaaggcctcaccttcactgacctgcctttgtgcctacaactgaacatcatgcagaggctgagcgacgggcgggacctggtcagcctgggccaggctgcccccgacctgcacgtgctcagcgaagaccggctgctgtggaagaaactctgccagtaccacttctccgagcggcagatccgcaaacgattaattctgtcagacaaagggcagctggattggaagaagatgtatttcaaacttgtccgatgttacccaaggaaagagcagtatggagatacccttcagctctgcaaacactgtcacatcctttcctggaagggcactgaccatccgtgcactgccaataacccagagagctgctccgtttcactttcaccccaggactttatcaacttgttcaagttctgaatcccagcacatgacaacacttcagaagggtccccctgctgactggagagctgggaatatggcatttggacacttcatttgtaaatagtgtacattttaaacattggctcgaaacttcagagataagtcatggagaggacattggaggggagaaatgcagttgctgactgggaatttaagaatgtgaacttctcactagaattggtatggaaaagcaaaatactgtaaataaactttttttctaacaatttgccaaaaaaaaaaaaaaaa

SEQ ID NO: 146 - DNA, 514 bp, Homo sapiens
cttcctttttgtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaataaaactttattaaatcaaaaaaaaaaaaaaaaaaaaaaaaa

SEQ ID NO: 147 - DNA, 1245 bp, Homo sapiens
atgcaccacgtgctgctggaggtagatgtgttggagggcaccctgcagtgcccagagtctggacgtgtgttccccatcagccgcaggatccccaacatgctgctgaatgatgaggaaacagagttgatcatgccagtctttcctgaatttctaaatcaaacccgtaggccacagtggcaggagactatagcagatgagaagcaacaaggggccaccctagtgtcctgcaaaggtctgagtctgcgggacccagatctgcatctccagaatgaacacagagagatgttccaggaggaaaagtacttccgggatagtaaaggtcggcccgcgcaagatggcggcccccttggaactcagttgctggggaggcggctggggactcccatcggttcacagcgagtccctggtggtgatggcgatgtaccaattttgacaactgaagacgacatggtttctcagccagcaaaaatactaaactttttaagaaaacagaaatataatgctgattatgaactctcagcaaaacaaggggcagatacattggcttatattgctctcctcgaagagaagcttctccctgcagtgcttcacacattctgggttgagagtgacaattactttactgtgacaaagccatggtttgcttcacaaattccttttcctttgagtttgatcctgcctggaagaatgtctaagggagcactgaataggattctcctgaccagaggacagcctcccctctaccacctccgagaagtggaagcacagatatacagagatgccaaggagtgcctaaatcttctatcaaacagattgggaacatctcagtttttctttggagatacgccttctaccttggatgcctatgtttttggttttcttgcacctctttacaaagtacggtttcctaaagttcagctacaagaacatctgaaacagctctccaacctctgtcgcttttgtgatgacatcctgagcagttattttaggcttagtcttggagcattttcctgcatgaacagaaatcagcagcagattgattttggcatctctccagctggacaagaaacggtagatgcaaatctgcagaaactcacacaacttgtaaataaggaatccaacttgattgaaaagatggatgacaatcttcgccaaagccctcagcttcctcctcggaaactgccaacacttaaattgactccagcagaagaagaaaataattccttccaacggctttcgccctga

SEQ ID NO: 148 - DNA, 2728 bp, Homo sapiens
ggggtagggaggccgactgagcaggagtcgtccgcttatagtggaggctgctaggagccggtcagagggtgagtggggagcaggcgagcgagccacagcaggcaggagggagcgtcgcgcggcgcagaggagcgccggggcagggccgcggcggaaccacagccggagaggggcagcccgagccgggcgccgcagggtccccacccccacccggccggacagtgcccggtgttcccccgtgcggggggcggcggcggcggctgacgggaccgccgggaccgcgggggtgttgccacctccaccgaggagccggcgcggccgcgggctcctcagagccggggccccgggcccgtgacagacgggccgaggaagggagagaggcggcggcgacaccatgtcatctcccagtccgggcaagaggcggatggacacggacgtggtcaagctcatcgagagtaaacatgaggttacgatcctgggaggacttaatgaatttgtagtgaagttttatggaccacaaggaacaccatatgaaggcggagtatggaaagttagagtggacctacctgataaataccctttcaaatctccatctataggattcatgaataaaattttccatcccaacattgatgaagcgtcaggaactgtgtgtctagatgtaattaatcaaacttggacagctctctatgatcttaccaatatatttgagtccttcctgcctcagttattggcctatcctaaccccatagatcctctcaatggtgacgctgcagccatgtacctccaccgaccagaagaatacaagcagaaaattaaagagtacatccagaaatacgccacggaggaggcgctgaaagaacaggaagagggtaccggggacagctcatcggagagctctatgtctgacttttccgaagatgaggcccaggatatggagttgtagtagaaaaagcacctgcttttcagaaagactattatttcctaaccatgagaagcagactataatattcatatttaaacaaagcaattttttttattactaaacaaggtttttatgaataatagcattgatatatatatattatatatcaccctttagatcttgatttcttggtcatttctcaacctgaggtgcatagcatattcccacattccatttggtagcaatatgcggtctgaatgcatgcattcatgagtccatgtggccaagtcagcctgtgtgctactgaactgtcgaaggaaatagccgctctgataggtagatgtgagtaaaaagaacaggaaaaaattgcttcttttattggtttccaaagaaacaaaccaaaccaaccagctcttggatgtgaagataaaatagtgcttttttgaaatggagaggaaaaacttggggaggaagaggcctgctgtgggggcatcggagccagccatgtaagaatcagagctgctccttcctgtgaatcctaggtggccctatgtcttctgtggagttacagtataaagcagggagctaattaagagtattaaaacttaaaaccattttttgactctgattttaagtacatttttatatgtcagttgctgcccttcacactaccaggccctgcagccacagtgttctgttggagaaacttggggaagtgttttctgaaccagttctttttcttggggtagagcgtgaaatccagacctgtttttgaaaggacagcacaggaggagaaaagtgactgggacgatgcttcctctcatccaaaacacatgcagagtcacatcctcatcctagtgtttggcagtttgagaccgctaccctgaacttaagagctttaaatatgagggttgtgtttctgggggggttatttttttggtgtgtgtgtgtgtgtattgtgcttagaaaggttgcagatttcatcttcacctaccaagaggcggccgcctccttggacaagccgctcatggaccattagacttgagaagacgacccacgtggtgactgcaaagccctgggtacttgccttcatgttctggtttggttttccctttttctgctgctcttggcagcagcctggtcatcatctgcttgtgggagtgggaaatgggtattttagacccaacacaggttctaaatttaaaacaaataataattggaacaaataaaggttcttgtacccagagtgattctacatgggaaaaacaaaccagcttttttcagagagtgaccgaataggaagaagggattcagaaatatgatgtagtagaacatgccctgcaggaagaaaatgttttctctcctgcgtatgttaagaggaaatcagtttaaaatgcctgctaatcaaatgtcgactcagctaaccatatgtccaggttgctgcagagtttctttcaaatctgagtgttgcctgctgaactcggaggggagtttggagaaattttagacagcagctctgtgttctttttttgccgcagccaataagataatagcagaattagccaatcctaaaaccttctaaagacgatttttgagcatcccactgggattatttaatttttctttttgacgtgtgtttttagtttagaagtgctgtattccacaaggtttaagtcagtgaggttggaagataccctatcttttttattcaaaaagcacaatcaatcttttgtttgaaaatctatataaagtacaacttgcttttagcatgattattttcctaaataaaaagacaaagaattt

SEQ ID NO: 149 - DNA, 1314 bp, Homo sapiens
ggcgcgccgcaggcagcactggcgggggcctttcctgccgccgacgccggggtcctccctcaggtctcattctgtgcctgtgaacatggcggcgcccgttgtcacggccccgggcagagctctgctgcgggcgggcgctggacggctgcttcggggaggcgtccaggagctactgcggccgcgacatgaagggaacgcccctgacctggcctgcaacttcagcctttctcaaaatcggggcacggtcatcgtggagcgctggtggaaggtaccgctggccggggagggccggaagccgcgcctgcaccggcgacatcgcgtctataagctggtggaggacacgaagcatcggcccaaagaaaacctggagctcatcctgacgcagtcggtggagaatgttggagtccggggtgacctggtctcagtgaagaaatctttaggccggaatcgactccttcctcagggactggctgtatatgcatcccctgaaaacaagaagctgtttgaagaggagaaattgctgagacaagaaggaaaattagagaagatccagaccaaggcaggtgaggcgacagtgaaatttctaaaaagctgtcgcctggaggtagggatgaagaacaatgtcaaatgggagctgaaccctgaaatagttgcccgccacttctttaagaatcttggtgttgtggttgccccacatacattaaagttaccagaagagcctatcacacggtggggcgagtattggtgtgaggtgacggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaaaaaaaaaaaaaaaaaaaaaaaa

SEQ ID NO: 150 - DNA, 1664 bp, Homo sapiens
tcatggccggctcctaccctgaaggtgcacctgcaatcctcgccgataagaggcagcagttcggaagccggttcctgagcgatccggcgcgggtcttccaccacaatgcctgttgattatgagatcaatgcccacaaatactggaatgacttctacaaaatccacgaaaatgggtttttcaaggatagacattggctttttaccgaattccctgagctggcacctagccaaaatcaaaatcatttgaaggattggttcttggagaacaagagtgaagtatgtgaatgtagaaacaatgaggatggacctggtttaataatggaagaacagcacaagtgttcttcgaagagccttgaacataaaacacagacacctcctgtggaggagaatgtaactcagaaaattagtgacctggaaatttgtgctgatgagtttcctggatcctcagccacctaccgaatactggaggttggctgtggtgtgggaaacacagtctttccaattttacaaacgaacaatgacccaggactctttgtttattgctgtgatttttcttccacagctatagaactggtccagacaaattcagaatatgatccttctcggtgttttgcctttgttcacgacctgtgtgatgaagagaagagttacccagtgcccaagggcagtcttgatattatcattctcatatttgttctttcagcaattgttccagacaagatgcagaaggctatcaacaggctgagcaggcttctgaaacctggggggatggtacttctgcgagattacggccgctatgacatggctcagcttcggtttaaaaaaggtcagtgtctatctggaaatttctatgtgagaggtgatggaaccagagtttacttcttcacacaagaggaactggacacgcttttcaccactgctggactggaaaaagttcagaacctggtggaccgccgactgcaggtgaaccgagggaagcaactgacaatgtaccgggtttggattcagtgcaaatactgcaagccccttctgtccagcaccagctaagaggcacctgctgccaacacgatgcaagcccgttgtgtttccgagctttttttaaaaaaaaatttgtagcaccgggcatggtgcatgcctgtaatcccagccactcaggaggctgaggcagggaggatccattgagcccaggagtccagcctgggcaaaatagcgagagaccctgaatctgaaagtaatgataaaataaaaagaatataaatgaggtctcgttgatgctggacaattcaagaattcagacttgaaccttaaacctaggaaaagttactttgtatcaggattctaacaattatgcttcatatttgtgaagtcctttaaaacataattttctcaagttctttctttgagacctcaatctgtcttagcattttgtaactaataactgaaattttattcaaaggaattgtaaaccttaaaccaccaatttatttccatgtgaaaaagtgttatatatgacaagtgttttttgattgtaattgcgttaaatcttttgagagtgtaaatgccgggctaggcaattgcagttaatacatacaggggttagtgaagggcttattaagttgtaggggaagcaagctgggaagaatcagatcagatattttcctgac

SEQ ID NO: 151 - DNA, 5067 bp, Homo sapiens
aggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtactttaaaaaaaaaaaaaaaaaa

SEQ ID NO: 152 - DNA, 1056 bp, Homo sapiens
tctctggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgtctgactacctgcttcaagattacccagtcaccgtggcctccaacctgcaggacgaggagctctgcgggggcctctggcggctggtcctggcacagcgctggatggagcggctcaagactgtcgctgggtccaagatgcaaggcttgctggagcgcgtgaacacggagatacactttgtcaccaaatgtgcctttcagcccccccccagctgtcttcgcttcgtccagaccaacatctcccgcctcctgcaggagacctccgagcagctggtggcgctgaagccctggatcactcgccagaacttctcccggtgcctggagctgcagtgtcagcccgactcctcaaccctgccacccccatggagtccccggcccctggaggccacagccccgacagccccgcagccccctctgctcctcctactgctgctgcccgtgggcctcctgctgctggccgctgcctggtgcctgcactggcagaggacgcggcggaggacaccccgccctggggagcaggtgccccccgtccccagtccccaggacctgctgcttgtggagcactgacctggccaaggcctcatcctggggaggatactgaggcacacagaggggagtcaccagccagaggatgcatagcctggacacagaggaagttggctagaggccggtcccttccttgggcccctctcattccctccccagaatggaggcaacgccagaatccagcaccggccccatttacccaactctgtacaaagcccttgtccccatgaaattgtatataaatcatccttttctaccaaaaaaaaaaaaaaaaaaaaa

SEQ ID NO: 153 - DNA, 701 bp, Homo sapiens
cggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgccgcatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgccaactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgtcctccacccagcgtgcgtgcacgtcctcc

SEQ ID NO: 154 - DNA, 2033 bp, Homo sapiens
cagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaatttaaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggaaaaaaaaaaaaaaaaaaaaaaaaaaaaaaaaaaaaaaaaaaaaaaaaaaaaaaaaaa

SEQ ID NO: 155 - DNA, 1154 bp, Homo sapiens
gggggccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagccaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctcaaaaaaaaaaaaaaaaaaaaaaaaaaaaaa

SEQ ID NO: 156 - DNA, 3076 bp, Homo sapiens
gtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctaaaaaaaaaaaaaaaaaaaaaaaaaaa

SEQ ID NO: 157 - DNA, 4020 bp, Homo sapiens
caccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttagataggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaaaaaaaaaaaaaaaaaa

SEQ ID NO: 158 - DNA, 1707 bp, Homo sapiens
gaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgctggtgagccccccgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgcccccccccttatccccctctgaagacgatgggcagaggagtgacagccgcagacacacgacagccggcagcaactggaatggcagcaattaagggtggggagcgggggttggggggttggggggttagggcagggaggggactggggaagtgcgcacacagccccacacagacaacacgcacg

SEQ ID NO: 159 - DNA, 568 bp, Homo sapiens
cgcagcggtcggaagcggagcaaggtcgaggccgggttggcgccggagccggggccgcttggagctcgtgtggggtctccggtccagggcgcggcatgggcgtcctggccgcagcggcgcgctgcctggtccggggtgcggaccgaatgagcaagtggacgagcaagcggggcccgcgcagcttcaggggccgcaagggccggggcgccaagggcatcggcttcctcacctcgggctggaggttcgtgcagatcaaggagatggtcccggagttcgtcgtcccggatctgaccggcttcaagctcaagccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagct

SEQ ID NO: 160 - DNA, 2344 bp, Homo sapiens
gacagctggaagagccgaacggataagagaagaggaggtgagaggagctgtacaccacaagaggcactgagggactcaggataacgggatgaagccgtcagtgcccccagaaacgaagcggccccggacgaatttctgagtcaccgtcgcgagaaagcgggctgagccgccattttgaagcctggcaaaccgaagcaagaaatgctgccgtgttggatctttgccagccttcgtgccgaatgggagcaggttggagggagggagagccaatatacactatgggctgattaagcccggttggctgccatgttgttaacgagcaccgatttcctctacttttgtcgaagaagtttattgtgggtcagggacgtcaggtcgcttgccttcgtttactgtggtcatgattgagcatatgaggacggccattattgttgggggcaaatggaaatgctctaggcggggccatttttcttaggggcaagctgtcgtcacccttgtcaactggttcggatgaagcccctgtggccgccatcttgatctcgggcggccccgataagggaggcggagtgtgcggagaggaggcggggcaactgcgcggacgtgacgcaaggcgccgccatgtcttttgagggcggtgacggcgccgggccggccatgctggctacgggcacggcgcggatggcgtcggggcgccccgaggagctgtgggaggccgtggtgggggccgctgagcgcttccgggcccggactggcacggagctggtgctgctgaccgcggccccgccgccaccaccccgcccgggcccctgtgcctatcctgcccatggtcgaggagccctggcggaggcagcgcgccgttgcctccacgacatcgcactggcccacagggctgccactgctgctcggcctcctgcgcccccaccagcaccacagccacccagtcccacacccagcccaccccggcctaccctggccagagaggacaacgaggaggacgaggatgagcccacagagacagagacctccggggagcagctgggcattagtgataatggagggctctttgtgatggatgaggacgccaccctccaggaccttccccccttctgtgagtcagaccccgagagtacagatgatggcagcctgagcgaggagacccccgccggcccccccacctgctcagtgcccccagcctcagccctacccacacagcagtacgccaagtccctgcctgtgtctgtgcccgtctggggcttcaaggagaagaggacagaggcgcggtcatcagatgaggagaatgggccgccctcttcgcccgacctggaccgcatcgcggcgagcatgcgcgcgctggtgctgcgagaggccgaggacacccaggtcttcggggacctgccacggccgcggcttaacaccagcgacttccagaagctgaagcggaaatattgaagtccagggagggagcgccccgggccgcgtccgccccgtcccacactacgcccccgccccactcccggggcctgctaatctgaggccgatccgggaccggcctccttgcgtctcccattcccaagattgtcccgcctctgccaatccccgccgtccttccagcccacgacctgccgcgccgaggagcggcatctgtcccgtttcccgattgggtctgtcgtctctctccgcctagcgacagattccttctattaagggattggctcgctgagttctaagctctaaatgggtcaactcctttgttttccgcctagcgacaagggatttgctcgcacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccctgaccccctcagggatggccccaaactgtccctgcctctggcaccccctttcattggttccatccatccccacaacagcctgccaatcgaagcccgtccctgcatccaggatggtaccagctcccgcccctcgccccccacctccacaggtgccttaaagggccctcgtccacccaaggtggggggcaggggccctcactctccggccctggtgtgggggagagagtgaggggttgggggatcggcagttgggaggggcgctctgagattaaagagttttacctctgagataaaaaaaaaaaaaaaaaaaa

SEQ ID NO: 161 - DNA, 531 bp, Homo sapiens
ggcccttcagtatgcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtgacactgcaccctcacggccacccgactactttgcctccttggatttcctccagggagaatgtgacctaatttatgacaaatacgtagagctcaggtatcacttctagttttactttaaaaaataaaaaaatagagacagagtctcaaaaaaaaaaaaaaaaaaa

SEQ ID NO: 162 - DNA, 1847 bp, Homo sapiens
aattcggcacgaggcgaggcgaccgctgaggccgcggagagtgacggcggcccggccgacgggagccggggcggggcggcggcccagcgaaggagcgcgcgggcggtctggccccgccccctccccgcccgccttcccggtgaccttcaggggcccgggtggcgggcgcaggcccctgcggcggcggcgggatgttcgtgcaggaggagaagatcttcgcgggcaaggtgctgcggctgcacatctgcgcgtccgacggcgccgagtggctggaggaggccaccgaggacacctcggtggagaagctcaaggagcgctgcctcaagcactgtgctcatgggagcttagaagatcccaaaagtataacccatcataaattaatccacgctgcctcagagagggtgctgagtgatgccaggaccatcctggaagagaacatccaggaccaagatgtcctattattgataaaaaagcgtgctccatcaccacttcccaagatggctgatgtctcagcagaagaaaagaaaaaacaagaccagaaagctccagataaagaggccatactgcgggccaccgccaacctgccctcctacaacatggaccgggccgcggtccagaccaacatgagagacttccagacagaactccggaagatactggtgtctctcatcgaggtggcgcagaagctgttagcgctgaacccagatgcggtggaattgtttaagaaggcgaatgcaatgctggacgaggacgaggatgagcgtgtggacgaggctgccctgcggcagctcacggagatgggctttccggagaacagagccaccaaggcccttcagctgaaccacatgtcggtgcctcaggccatggagtggctaattgaacacgcagaagacccgaccatagacacgcctcttcctggccaagctcccccagaggccgagggggccacagcagctgcctccgaggctgccgcgggagccagcgccaccgatgaggccagagatgagctgacggaaatcttcaagaagatccggaggaaaagggagtttcgggctgatgctcgggccgtcatttccctgatggagatggggttcgacgagaaagaggtgatagatgccctcagagtgaacaacaaccagcagaatgccgcgtgcgagtggctgctgggggaccggaagccctctccggaggagctggacaagggcatcgaccccgacagtcctctctttcaggccatcctggataacccggtggtgcagctgggcctgaccaacccgaaaacattgctagcatttgaagacatgctggagaacccactgaacagcacccagtggatgaatgatccagaaacggggcctgtcatgctgcagatctctagaatcttccagacactaaatcgcacgtaggtggcgttgttccactcggctatcaggccacagcagccccctggtgcggcccgagaccgggcagagtggacctcacctggaaactcaccttcagcgcctcagccctggactgttagaggtgctgcagctgctcctgctctctgatcttattgcttataaactttggtgacggtagtgtgtaaggccgtatttttagcatctgacaggtgtttacaaaaaagtggttgtcgcactgggaagtggagtgatggcctcgtctccagtgctcctctgggctcttgagttgctgcttgaattgccgtgtagacatttgcttggagagtccacttgttatttgacggaggtaggtttcaacccagagttaatgtcaagcatgctaatttaactagtcactcacagatgacttttctttaataaagtcccttttcctaaaaaaaaaaa

SEQ ID NO: 163 - DNA, 1222 bp, Homo sapiens
tgacgcatactatagcgctgttttcctgcactgataaacgaaaagcaatccaccaggtctcggcagctaactttccggcactacttatgcccgagcgtgtcgtcccagtgcgcaagtgcagcaggtggctacggaggggcgcgggaggaagaggaggaggaggaggaggctgggttgggccggcgcaagtgctgtgatgcggttccgggcagggttctgtagaatctgaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgctctttgccatcggctcccagctgtctcctgaacagggaagctcaggcattgagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttggtgtttgcgtaaaaaaaaaaaaaaaaaaaaaaaaaaaaaa

SEQ ID NO: 164 - DNA, 2195 bp, Homo sapiens
gcgatggcaggttcgccgggtgtgaggcttcacagcggtccggtgaccaagtcgagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggtgaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagtcagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatgagatcttgttaaacatcacagaattcatacaggtgagaaaccctatgaatgtgatgaatgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattaaacaccagagaatccacactggggaaaaaccatataaatgcagtgagtgcaggaaggctttcagtcagtgctcagctcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccgcactggatccggatacgtgtggtggctcacgcctgtaatcccaacactttgggaggcagatgtggaagcatcatttgagcccaggagtttgaggctgcagtgagctatgattccaccattgcactccagtctgggcaacagagcaagaccctgtctattt

SEQ ID NO: 165 - DNA, 2733 bp, Homo sapiens
tcatggctgcgcgtgcagacgtgcgtcatcgccgcgcgccgcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaaaaaaaaaaaaaaaaaaaaaaaaa

SEQ ID NO: 166 - DNA, 3148 bp, Homo sapiens
cgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaa

SEQ ID NO: 167 - DNA, 2389 bp, Homo sapiens
gccggggcctcggccatgttcgcggggctgcaggacctgggcgtggccaacggcgaggacctgaaggagaccctgaccaactgcacggagccgctcaaggccatcgagcagttccagacagagaatggtgtgctgctgccatctcttcagtcagccctccccttcttggacttgcacgggacgccgcggctggagttccaccagtcggtattcgatgagctgcgggacaagctgctggagcgagtgtcagccatcgcttcggaggggaaggctgaggaaaggtacaagaagctggaagaccttctggagaagagcttttctctggtgaagatgccgtccctgcagcccgtggtgatgtgcgtcatgaagcacctgcccaaggttccggagaaaaaactgaagctggttatggctgacaaggagctgtatcgagcctgcgccgtggaggtgaagcggcagatctggcaagacaaccaggccctcttcggggacgaggtttccccactcctgaagcagtacatcctggagaaggagagcgctctcttcagtacagagctctctgtcctgcacaactttttcagtccttcccccaagaccaggcgccagggcgaggtggtgcagcggctgacgcggatggtggggaagaacgtgaagctgtacgacatggtgctgcagtttctgcgcacgctcttcctgcgcacgcggaatgtgcactactgcacgctgcgggctgagctgctcatgtccctgcacgacctggacgtgggtgaaatctgcaccgtggacccgtgccacaagttcacctggtgcctggacgcctgcatccgagagcggttcgtggacagcaagagggcgcgggagctgcaggggtttctcgatggcgtcaagaaaggccaggagcaggtgctgggggacctgtccatgatcctgtgtgaccccttcgccatcaacacgctggcactgagcacagtcaggcacctgcaggagctggtcggccaggagacactgcccagggacagccccgacctcctgctgctgctccggctgctggcgctgggccagggagcctgggacatgatcgacagccaggtcttcaaggagcccaagatggaggtagagctcatcaccaggttcctcccgatgctcatgtccttcctggtggatgactacactttcaatgtggatcagaaacttccggctgaggagaaagccccagtctcatatccaaacacacttcccgaaagcttcactaagtttctgcaggagcagcgcatggcctgcgaggtggggctgtactacgtcctgcacatcaccaagcagaggaacaagaacgcgctcctccgcctgctgcccgggctggtggagacctttggcgacttggcctttggcgacatcttcctccacctgctcacgggcaaccttgcgctgctggccgacgaatttgcccttgaggacttctgcagcagcctcttcgatggcttcttcctcaccgcctctccaaggaaggagaacgtgcaccggcacgcgctgcggctcctcattcacctgcaccccagggtggccccatctaagctggaggcgttgcagaaggccctggagcctacaggccagagcggagaggcagtgaaggagctttactcccagctcggcgagaagctggaacagctggatcaccggaagcccagcccggcacaggctgcggagacgccggccctggagctgcccctccccagcgtgcccgcccctgccccgctctgagggccctccagacctgctcgggtgctggggccatgccgagtcgcggccctgctcagccggaagaggctcccggacctggatgtacagggcagtctctcttcccggggctatggctgggcctgtcctgccgtcatggccccctgcttcctgctccttggagctggctcccggaccttgcccaccatccatgcagtggctcccagggcagagcctctccttgtactttggcagccatagaaagcgtgctcattttctgttttcctgtgttaggaaaaaaccacctgttttccaaggggagagggcggggcctgagggtgggggcggggcctcttcattggcccagcttggcgaaagcgaggcacactgcttactgccttggggttgtggagatggacccgtgacctcgtggaggccgtgtgggggcagcagcctggcctgtgccatggtgggtgtcctggggcctgtgcggagggagccacctcaccctgcagcccaggttgcaggtgtggccttgtttctccttgcccagcagtgctgccttcagcggccgtgacggggccagctggacacacggtgagattttctcgtatgtaaataaaaggcaatttggtaaaaaaaaaaaaaaaaaaaa

SEQ ID NO: 168 - DNA, 4425 bp, Homo sapiens
gcgcgcgtggggctccattccgcggtgctgggtctccgtgccggggtgggtgctcgtgtgtgcgcttctcctccccatcccccttcccccaagaataaaagaagaaccgggaggcgtgctcagaaaataaataaataaccaccacacacgcgcagcccggagcgagtcggcggggctggcggcagcggcggaggaggagtgaaggcggcggcggcggaggagggacgcgcggaaaaggcagcaactttaaagccagctcagagcctagacctccagccgagcggtttgcagcgcggcggcggcggcggcggcggcggcggcggcgttgagtgtctggcccgccggtccggtcggggtgtgcagtcggacggacgagcagcgcgtcgctgtcctccggcagctggagatgtccgagcccaaggcaattgatcccaagttgtcgacgaccgacagggtggtgaaagctgttccatttcctccaagtcaccggcttacagcaaaagaagtgtttgataatgatggaaaacctcgtgtggatatcttaaaggcgcatcttatgaaggagggaaggctggaagagagtgttgcattgagaataataacagagggtgcatcaattcttcgacaggaaaaaaatttgctggatattgatgcgccagtcactgtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtgaccacttcctgttcacttttttttttttttttttttttttttgagctgcggggcatgatggggattgctgcatatcagcagttggatgttcttgcctctgacagtagcttatttgctctgggggccaggaattggattcagtttacactatcattaaaaaagagggagagagataataaactatattttggtggggatggtgattaaacacctcttttgggtatgccttttaaaaatgcttatagagaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgtcagacaatggctataaactgaattaggcagtcttaaaaaaaaaaaaaaaacagaaaaagaaaaaaaagaacgttgcaaatttgttaaaatgccaaaaaggacagtttaattttgtacagattatgcttacctcaggtttctttagtgtgcttgaatgcccttctttccatataacacttatcttcttcttaattcggcaatggaatatcttttaagttttaaaaaaactggaataattatatctatcttttttgccgtttatatttaggggtttttgttgataaaatcaagtcttggttgtggcttgctgaattaaatatttatgagtggtgcatttttaagtatagtgaacaagacaccatattaagtacagtgataaagcatctatattctgtaaaaaaaaaaaaaatctgcctatgcatgttttttaagaaaaaaaaaatggctgtatcggcctgtatgggactgtaatgcgcttagtggtctgacatatactggaaatgtatgtatactggcgtactttatattctctaaaatgcttaatgcctttgaaattttgtaatcaaaaaaaagctttgaaaaaatctaaaggggagagtattctttaaagtttttaacataagcttgtcaatgcacatgtagatggttagcatgtttagcaaaccttgtgaaattataataagtttgtagttacatgtgaaactctaaatgcatggcaactgttaatgtcataacagtttagttattttgttctgttctgtcatgtgccacaaaatatgtacttttttcacttttttccctttgtatatcagttacgggttacaactggttcattctgaaaacaacaacaacaaaagtccattcatattttttaacaattgtataagtgcccaagtaattcactacagcctaaagccttgcctttgtaatttgacttctgacatgttggcaatcaaagcatgcacttgtaacaatgaaaaagaaaaagcattttatattactactcaataaaatgtgcatgaacttacagaattctcatccttccactgagtccgctgaagggatttatgtgcacaaccaccatgtgtcttctaggtgctggcccaccaccacacatcacaggctgatttccacaggcttcttcctaggggcctcgtgatctgaggggtggtgcctacttccactgtaagaaagaatcttggtggatttgtgtctcaaatcagataagagaagcctgtttaaagagcagatgccatcttctggcttcctcaaggagccagttaaaaaaccagagcattcctttttattgaaaaataaaattaatttgttatcaggttgtttcagttgtattggatgccctatctatctgctaaagcaaaaagtactaggctactaagtgcattttcatcacagaaaagagttgcatttgtattaacaagaaatttgtatacccacgcttcagctactatctaatcatcacccgaagatttaagatacaccaaatttcagtttgtttgtaacattgttcatctttagtgcactttgttttatataataaagtatgcctgttatattaaataataagaatatggcaattagcgatatagcatacccaaacaaagatgttctcgatacagtctggcaaagactatcccaaggttattttaatgaattcagacattttttcctgtggatatttctccatcctaaaaaaagtggcaaccaaggaaaatatttagatgcaacttactagagtgatgatgtgaaagaaatggtgattctggtatcatggtgtttattttctttcttataactgcagagaaaatatcctgactaaaaaaatttcatttttttggattcctttcttttacaaattgtgctgaggcaactatggcatagaaataaacatttgacattaaaataagtaaaaaaaaaaaaaaaaaaaa

SEQ ID NO: 169 - DNA, 344 bp, Homo sapiens
cctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 170 - DNA, 1662 bp, Homo sapiens
ggctgagcagcggcctggtgcgctcgcttagcgggcgacggaatcagacggacgtggacgcccccggagtggaagccgaagcaggagttgttgttgctgaggggctgccgcagccgccgcgagcctccggacagacgccagagcgaggagggcgctacgcgacttggcaagatgacccagttcctgccgcccaaccttctggccctctttgccccccgtgaccctattccatacctgccacccctggagaaactgccacatgaaaaacaccacaatcaaccttattgtggcattgcgccgtacattcgagagtttgaggaccctcgagatgcccctcctccaactcgtgctgaaacccgagaggagcgcatggagaggaaaagacgggaaaagattgagcggcgacagcaagaagtggagacagagcttaaaatgtgggaccctcacaatgatcccaatgctcagggggatgccttcaagactctcttcgtggcgagagtgaattatgacacaacagaatccaagctccggagagagtttgaggtgtacggacctatcaaaagaatacacatggtctacagtaagcggtcaggaaagccccgtggctatgccttcatcgagtacgaacacgagcgagacatgcactccgcttacaaacacgcagatggcaagaagattgatggcaggagggtccttgtggacgtggagaggggccgaaccgtgaagggctggaggccccggcggctaggaggaggcctcggtggtaccagaagaggaggggctgatgtgaacatccggcattcaggccgcgatgacacctcccgctacgatgagaggcccggcccctccccgcttccgcacagggaccgggaccgggaccgtgagcgggagcgcagagagcggagccgggagcgagacaaggagcgagaacggcgacgctcccgctcccgggaccggcggaggcgctcacggagtcgcgacaaggaggagcggaggcgctccagggagcggagcaaggacaaggaccgggaccggaagcggcgaagcagccggagtcgggagcgggcccggcgggagcgggagcgcaaggaggagctgcgtggtggcggtggcgacatggcggagccctccgaggcgggtgacgcgccccctgatgatgggcctccaggggagctcgggcctgacggccctgacggtccagaggaaaagggccgggatcgtgaccgggagcgacggcggagccaccggagcgagcgcgagcggcgccgggaccgggatcgtgaccgtgaccgtgaccgcgagcacaaacggggggagcggggcagtgagcggggcagggatgaggcccgaggtgggggcggtggccaggacaacgggctggagggtctgggcaacgacagccgagacatgtacatggagtctgagggcggcgacggctacctggctccggagaatgggtatttgatggaggctgcgccggagtgaagaggtcgtcctctccatctgctgtgtttggacgcgttcctgcccagccccttgctgtcatcccctcccccaaccttggccacttgagtttgtcctccaagggtaggtgtctcatttgttctggccccttggatttaaaaataaaattaatttcctgttgaaaaaaaaaaaaaaaaa

SEQ ID NO: 171 - DNA, 4284 bp, Homo sapiens
gggagggatgtcagccttctctgaggcggcgctggagaagaagctgtcggagttgagcaactcgcagcagagcgtgcagaccttgtccctgtggctcattcaccaccgtaaacactcgcggcccatcgtcaccgtgtgggagcgggagctgcggaaagccaaaccaaacaggaagcttacttttctctacctagccaatgatgtcatacagaacagcaagaggaaggggccagagtttacaaaagattttgcaccagttatagtggaggcttttaagcatgtttcaagtgaaactgatgaaagttgtaagaagcaccttggaagagtgttatctatttgggaagaaaggtctgtttatgaaaatgatgtattagaacaacttaaacaagctctgtatggtgataagaagcctaggaagcgaacttatgaacagataaaggtggatgaaaatgaaaactgttcctctctgggatctccaagtgaaccaccacagactctagatctcgttagagcattacaagatctggaaaatgcagcctcaggtgatgcagcagttcatcagaggatagcttctttacctgttgaagtccaagaagtatctctattagataaaataacagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagagtacaagcgcaagctagccagagtttccctggtgcgcaaagaactcaggtcccggatccagagcctgccagacttatctcgattgcccaatgtcactggcagccacatgcacctgccctttgcgggagacatctacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagttaagcagtgccacactacagggtagatatggtaaattttatatttgtatatttacagttacaaaacaaatgtacttttaccttttatttctgaccctgtgtgttagagcagttgcatgctctcctgctgttaaaaacacattgttaagctgtggatttgtactcaataatgacttaggataaacatttattttcattcattgctttacatactagacatttttcttctctttgtaagtagattcaaattagatagtcaataaaacatcttgaaaatcccacaagccaattatgtctctctagtctgaatggcttcattgtttctttctcagtattagaaattatagttacaatgaattgcatatgaagaaggcagacatttatttttaatagccaagtagttctgcaaatagttcttttaacaatttgacctctctccaaaacagagacacatataagtagtgctcatccatgcactactaataatacatggcttattccaaagtttttagtcaacttttgggacttggggtgcattttctcacagaaagaatagtagttaggttccctaacactaccgctgatagctcacctgggaactgaatccacctaaccatgaatgtccttcacttgtaacgtggttcacaggttactaatcatagatcctgaccagcatttgtaacactgctctaactaggacacagcatgcagcagccacactcacaccctgggatgtctgtgtacctctgtccctaggtgtaggaaatggaagaaaaagattcagccaagtggggaggtgacagatgcacaattatgaaacctggttgtacatgttatgaaagtatactaagtaagttagtttttattattaatgtgaaagcaaaaacttgtatgttaacttattttcaatatcttgaccttatttatgatctgctaaagtggtgatttatccattcaaaatatatatttttttccatttaaaactaatttataaactatgtactcctgggaagatttgaaatcttttagaagtttgttgaaatattttcaccatttcagacagacttctgacttagatactgattttaatgccagtatctgctctaaatatttatgataaaaatgcattatttttttaaagagcttgatgagatttgtgataagtgatagtactcaaaaacctgaatcccacccctcgaccaatcctccacaaacttcagttgttggttaacgtattaactgaacacagacaatacagtctgatttagaagtcatcttttcagccgtgtgataattaacatggtaagccttagcagcaaacattcttcctaaaaggaagacttcattttctcaagaaatgggattagttgggggtattataataccaaattgtaaatcatgagcgttttctccactgtgcacctgaggcagatcatgcatctttgagtgcagtttggtctgacccctcaagagaaaagcatggtgccgtagggctgctatggtttgaatggatgccatcactcttttctccacatacagtgcagagagctgtctggagtcacaatctgaacagattctcgggcgctccttctctccttccatcactacagtaagtaaaaggaccatagaggggaaccaggaatctgagaatcagctgtgctcaatagccaacctccctgtccagatgcagctattttggtatctcctatcacatgcactctgaatcagggtttttctataagaaatctttcagaatcagcaaaagtggggatgacccaggcatcttgatttgcaaaatcacaaaactaagttgtcagttatcactgtagatgagcaactcatctttttaaagtatagttactgaactgattctgagaaatctttagagagaaaaaactcaacagtacaaattaactaattgggaaagttagaatgtcctttctgaatttttcattaaaaaaattacattatctgaaataacataaagctactaaactgctttgtattctattaagaaatagctcctaaggatgtagtcttgtttcatagttgttgcactatatcaaaacttaaaatgtaagcccagttcttctctgtatagaaaggaaacattgtgttacttaatgaattatttatacagagcatttgttgccaactgttgttccagccatccacacaggagtctgttctgaggtggcaatagcacatgggaagatgaactttccctgtttgtttacccgttcttctttggctgtatctgatgacagtataagatgttcttaataaagttttatgttctttttgaaaaaaaaaaaaaaaaaa

SEQ ID NO: 172 - DNA, 890 bp, Homo sapiens
ggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 173 - DNA, 2460 bp, Homo sapiens
gtgtggaacatgccttcaccacctccagcttctgctgccggaggctgcacccacctgtgcccatggcctgcacaggcccatcacttcctagcgccttcgacattctaggtgcagcaggccaggacaagctcttgtatctgaagcacaaactgaagaccccacgcccaggctgccaggggcaggacctcctgcatgccatggttctcctgaagctgggccaggaaactgaggccaggatctctctagaggcattgaaggccgatgcggtggcccggctggtggcccgccagtgggctggcgtggacagcaccgaggacccagaggagcccccagatgtgtcctgggctgtggcccgcttgtaccacctgctggctgaggagaagctgtgccccgcctcgctgcgggacgtggcctaccaggaagccgtccgcaccctcagctccagggacgaccaccggctgggggaacttcaggatgaggcccgaaaccggtgtgggtgggacattgctggggatccagggagcatccggacgctccagtccaatctgggctgcctcccaccatcctcggctttgccctctgggaccaggagcctcccacgccccattgacggtgtttcggactggagccaagggtgctccctgcgatccactggcagccctgcctccctggccagcaacttggaaatcagccagtcccctaccatgcccttcctcagcctgcaccgcagcccacatgggcccagcaagctctgtgacgacccccaggccagcttggtgcccgagcctgtccccggtggctgccaggagcctgaggagatgagctggccgccatcgggggagattgccagcccaccagagctgccaagcagcccacctcctgggcttcccgaagtggccccagatgcaacctccactggcctccctgatacccccgcagctccagaaaccagcaccaactacccagtggagtgcaccgaggggtctgcaggcccccagtctctccccttgcctattctggagccggtcaaaaacccctgctctgtcaaagaccagacgccactccaactttctgtagaagataccacctctccaaataccaagccgtgcccacctactcccaccaccccagaaacatcccctcctcctcctcctcctcctccttcatctactccttgttcagctcacctgaccccctcctccctgttcccttcctccctggaatcatcatcggaacagaaattctataactttgtgatcctccacgccagggcagacgaacacatcgccctgcgggttcgggagaagctggaggcccttggcgtgcccgacggggccaccttctgcgaggatttccaggtgccggggcgcggggagctgagctgcctgcaggacgccatagaccactcagctttcatcatcctacttctcacctccaacttcgactgtcgcctgagcctgcaccaggtgaaccaagccatgatgagcaacctcacgcgacaggggtcgccagactgtgtcatccccttcctgcccctggagagctccccggcccagctcagctccgacacggccagcctgctctccgggctggtgcggctggacgaacactcccagatcttcgccaggaaggtggccaacaccttcaagccccacaggcttcaggcccgaaaggccatgtggaggaaggaacaggacacccgagccctgcgggaacagagccaacacctggacggtgagcggatgcaggcggcggcactgaacgcagcctactcagcctacctccagagctacttgtcctaccaggcacagatggagcagctccaggtggcttttgggagccacatgtcatttgggactggggcgccctatggggctcgaatgccctttgggggccaggtgcccctgggagccccgccaccctttcccacttggccggggtgcccgcagccgccacccctgcacgcatggcaggctggcacccccccaccgccctccccacagccagcagcctttccacagtcactgcccttcccgcagtccccagccttccctacggcctcacccgcaccccctcagagcccagggctgcaacccctcattatccaccacgcacagatggtacagctggggctgaacaaccacatgtggaaccagagagggtcccaggcgcccgaggacaagacgcaggaggcagaatgaccgcgtgtccttgcctgaccacctggggaacacccctggacccaggcatcggccaggaccccatagagcaccccggtctgccctgtgccctgtggacagtggaagatgaggtcatctgccactttcaggacattgtccgggagcccttcatttaggacaaaacgggcgcgatgatgccctggctttcagggtggtcagaactggatacggtgtttacaattccaatctctctatttctgggtgaagggtcttggtggtg

SEQ ID NO: 174 - DNA, 3253 bp, Homo sapiens
actacttctgcgcctgcgcgaccgtgattccccgctcgcgactccccaccccccagggctccctaaagagggccacgagctgcgaaagggcgggaaaggcagttggagaagaggtaagcggttactcactccatggctgcagcaaggagaggcggcggcggcctcggctgaagaaagaagaaatcttcccaaggctgcagacaccgacggatttgctttgggagccagagtagctgccgccaccagagtccggagccatgagcgggtttaattttggaggcactggggcccctacaggcgggttcacgtttggcactgcaaagacggcaacaaccacacctgctacagggttttctttctccacctctggcactggagggtttaattttggggctcccttccaaccagccacaagtaccccttccaccggcctgttctcacttgccacccagactccggccacacagacgacaggcttcacttttggaacagcgactcttgcttcggggggaactggattttctttggggatcggtgcttcaaagctcaacttgagcaacacagctgccaccccagccatggcaaaccccagcggctttgggctgggcagcagcaacctcactaatgccatatcgagcaccgtcacctccagccagggcacagcacccaccggctttgtgtttggcccctccaccacctctgtggctccagctaccacatctggaggcttctcattcactggtggaagcacggcccaaccctccggtttcaacattggctcagcagggaattcagcccagcccacggcacctgccacgttgcccttcactccggccacgccagcagccaccacagcaggtgccacacagccagctgctcccacacccacagccaccatcaccagtactgggcccagcctctttgcgtcaatagcaactgctccaacctcatctgccaccactggactctccctctgtacccctgtgaccacagcgggcgcccccactgctgggacacagggcttcagcttaaaggcacctggagcagcttccggcacctccacaacaacatccaccgctgccaccgccaccgccaccaccaccagcagcagcagcaccaccggctttgccttgaatttaaaaccactggcgccagccgggatccccagcaatacagcagctgccgtgaccgctccacctggccctggcgcagctgcaggggcggctgccagctccgccatgacctacgcgcagctggagagcctgatcaacaaatggagcctggagctagaggaccaggagcggcacttcctccagcaggccacccaggtcaacgcctgggaccgcacgctgatcgagaatggagaaaagatcaccagcctgcaccgcgaggtggagaaggtgaagctggaccagaagaggctggaccaggagctcgacttcatcctgtcccagcagaaggagctggaagacctgctgagcccactggaggagttggtcaaggagcagagcgggaccatctacctgcagcacgcggatgaggagcgtgagaaaacctacaagctggctgagaacatcgacgcacagctcaagcgcatggcccaggatctcaaggacatcatcgagcacctgaacacgtccggggcccccgccgacaccagtgacccactgcagcagatctgcaagatcctcaatgcgcacatggactcactgcagtggatcgaccagaactcggccctgctgcagaggaaggtggaggaggtgaccaaggtgtgcgagggccggcgcaaggagcaggagcgcagcttccggatcacctttgactgagcgacagcagccctggggcccgcaggtccctagggagttcatgaggggaatgcgccctgttgtctgtagtttggggttgtggcaagatacttgtttgtttctttctttctttcacatgactgcccttgacatgatcgctgtgtgctttgcgtttttccatttaggagggtattctgggccttctgcccaggcagcagcctcatgggtgtggcttctgtggctttcatttgagtatctttggccccttttcacctactgcgaccacccacctcatcctggctcagcctggtgatggagaagtgctgatggtcttggtcccagccagggtcgtgggggcagccactctctccaaagcatagtcataggtgtcatgaaaaaataccaaatgtaagagaacctccaagtcagggcgcagtggctcacccctgtaatctcagcactttgggtggccaaggcgggcagatgacttgaggtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagagactctgtctcaaaaaaaaaaaaaaaaaaaaagaaactcccaggagacagcagcctagttttcgagtgtgagcttgtgcttgtgaaagctaaccatgctaaccaccaaggcaaagcagcacagtgtgaatagaacagagcgggatcaagaatttcacagaagacaggtcagctgaggggcctgcacacacagggtgttgaggaaccacagatgggcgccgagaggcctgccttttgcctggcccaggctcacccccaccttgggcctcacctcctccaggaagccttcccagctacccgaagctcaggtggccttcttgcaggtccccgtagcaccctgagcctgtaccttgggtggcacttgttatgctatcctgtgctagccgtttgtgcctcgtctcgctgttagattgtgagttcccatgggcagagacccactgtcgttccccgtgtgtccccagcccggtccctgtcacatttgttaaatgaaagaacaatgaagcccagtgtaacgtcagtccacagaaatagccacagcttccagtggtggccgtagacttggctcggaacttagtggcaccagagtaactctagtcagttacagtaaaatccactgtgtgtggaaggcagaagctagcggttgtatcccaagcatcttttgtatttgtctttatactttgctgaattctctgaaatacctattactgtatgttgcttttctaaataaatgtattgtgaaaccaaaaaaaaaaaaaaaaa

SEQ ID NO: 175 - DNA, 1373 bp, Homo sapiens
ggggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatcgcggggttcctgcgaggcccagactggtccatccccatcttggactttgtggaacagaaatgtgaagttaactgcaaaggagggcatgtgataactccaggaagcccagagccggtgattttggtggcctgtgttccccttgtttttgatgatgaagaagaaagcaaattgacctatacagagattcatcaggaatacaaagaactagttgaaaagctgttagaaggttacctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgaccaggaagaagaaaggaagaggaaaaaacagttatcagaggctaaaacagaagagcccacagtgcattccagtgaagctgcaataatgaataattcccaaggggatggtgaacattttgcacacccaccctcagaagttaaaatgcattttgctaatcagtcaatagaacctttgggaagaaaagtggaaaggtctgaaacttcctccctcccacaaaaaggcctgaagattcctggcttagagcatgcgagcattgaaggaccaatagcaaacttatcagtacttggaacagaagaacttcggcaacgagaacactatctcaagcagaagagagataagttgatgtccatgagaaaggatatgaggactaaacagatacaaaatatggagcagaaaggaaaacccactggggaggtagaggaaatgacagagaaaccagaaatgacagcagaggagaagcaaacattactaaagaggagattgcttgcagagaaactcaaagaagaagttattaataagtaataattaagaacaatttaacaaaatggaagttcaaattgtcttaaaaataaattatttagtccttacactg

SEQ ID NO: 176 - DNA, 3622 bp, Homo sapiens
aggggacgctgctttccgcgctggacggaccaagcgagggagggtgcgaggggaaaccggaaggaagaggcggcggcgccagccttcctcggccggaggcggaggcgagaccccaggcgaggccgcggcgggagggccacgcccccgccgccgcgccggaggggcccagtgtggacggggccacgggctggagcggatcccacacctccggaccgagggacgcggttactccacaggatccgctgaacataggatgttgccacaaaatctacctcgtgtatttttctctttcactcatgagctgcacaattgcagatttgagcacaatgtctgcagactgtgttgaaaaactctgaagaacctaattaacacaggatgacctaggagtgattctaagtctgtgtaacaagatattactcattagtgaatgtgtcagtcttggtactgaatgctgcagataacagcaagtaggttctcctttatttctgaagtattcacttgaccttccatcagtaagacggacttttctaatctgttcctggagatattaatggaatacagtcatgtccactcaagacgagaggcagatcaatactgaatatgctgtgtcattgttggaacagttgaaactgttttatgaacagcagttgtttactgacatagtgttaattgttgagggcactgaattcccttgtcataagatggttcttgcaacatgtagctcttatttcagggccatgtttatgagtggactaagtgaaagcaaacaaacccatgtacacctgaggaatgtcgatgctgccaccttacagataataataacttatgcatacacgggtaacttggcaatgaatgacagcactgtagaacagctttatgaaacagcttgcttcctacaggtagaagatgtgttacaacgttgtcgagaatatttaattaaaaaaataaatgcagagaattgtgtacgattgttgagttttgctgatctcttcagttgtgaggaattaaaacagagtgctaaaagaatggtggagcacaagttcactgctgtgtatcataaggacgcgttcatgcagctgtcacatgacctactgatagatattctcagtagtgacaatttaaatgtagaaaaggaagaaaccgttcgagaagctgctatgctgtggctagagtataacacagaatcacgatcccagtatttgtcttctgttcttagccaaatcagaattgatgcactttcagaagtaacacagagagcttggtttcaaggtctgccacccaatgataagtcagtggtggttcaaggtctgtataagtccatgcccaagtttttcaaaccaagacttgggatgactaaagaggaaatgatgattttcattgaagcatcttcagaaaatccttgtagtctttactcttctgtctgttacagcccccaagcagaaaaagtttacaagttatgtagcccaccagctgatttgcataaggttgggaccgttgtaactcctgataatgatatctacatagcagggggtcaagttcctctgaaaaacacaaaaacaaatcacagtaaaacaagcaaacttcagactgccttcagaactgtgaattgcttttattggtttgatgcacagcaaaatacctggtttccaaagaccccaatgctttttgtccgcataaagccatctttggtttgctgtgaaggctatatctatgcaattggaggagatagcgtaggtggagaacttaatcggaggaccgtagaaagatacgacactgagaaagatgagtggacgatggtaagccctttaccttgtgcttggcaatggagtgcagcagttgtggttcatgactgcatttatgtgatgacactgaacctcatgtactgttattttccaaggtctgactcatgggtagaaatggccatgagacagactagtaggtcctttgcttcagctgcagcttttggtgataaaattttctatattggagggttgcatattgctaccaattccggcataagactcccctctggcactgtagatgggtcttcagtaactgtggaaatttatgatgtgaataaaaatgagtggaaaatggcagccaacatccctgctaagaggtactctgacccctgtgttagagctgttgtgatctcaaattctctatgtgtgtttatgcgagaaacccacttaaatgagcgagctaaatatgtcacctaccaatatgacctggaacttgaccggtggtctctgcggcagcatatatctgaacgtgtactgtgggacttggggagagattttcgatgcactgtggggaaactctatccatcctgccttgaagagtatccatggaaaccaccaacttatcttttttcaacggatgggacagaagagtttgaactggatggagaaatggttgcactaccacctgtatagtggggaagttcagggagtgcacgcctgagttatgtgctttgtcattttctttgctaaacaaaagaggctatgaaagaactaaatatgagtacataaaattctatctttgataaattttatttttatgccctacttaatatttgcatcagtataatatatatcagtgagtcttacagaaagatatgcttccataatatgaaatagattattcaataattgagaaactttatgtgtaatcatgagagtataagaatctggattatctaacattgttagccctgtgtatgtacagttcaaaaagttcatttataaaagtagtttcctgttcctagtgtgatgtatcacaaattgtgctgaggttattttagtatgtgtgtttcattcccgtgcttctgttctgaagtcctggaatacagttttcagtgtaattaattcaactgcacttaacactaatgtccgtgttggtatagaaatgtctaaatcctatactctagttgaggaagatcttccataattttatggtattacacagggaaagctatgactgcaggatcagtctaactatactattaggtgcatgtattctcttttcactaacttatacttgtctatctagaatacaggtcttccagtcagctggtcatttaccaggtgtggacttaagttgctgggcttgcagtaagaattgccagccactcattgtgcgggtctgcgtggagctttaatcagaaaaagcctccactttctgtattatgttaacattggctcatgcatataactatctgctgctgatgtagttctccatcttcaagatttagagtgggttaaccaggtcattacatcttaatttaataacaagcattactgtagagtgattgtgtatagatctgttagctgtcagggtgtgttttttttaacctgttgtgtgcgtgtgggggttaggattagtaaggtgaactgttcaggaattctctgcactagctgtgcagaagagcagataactagcgctgctctggcattaatcccaggaaccactagcagtagtggggcgccgccaatctaacatgagcacaggtgcttcatgacaaacattactagcatgttcaactgcaccatgttctggcactgtattttgaatgacattaatttattaaataaattgtatatattcaaaaaaaaaaaaaaaa

SEQ ID NO: 177 - DNA, 873 bp, Homo sapiens
cgcagtttgaatcgcggtgcgacgaaggagtaggtggtgggatctcaccgtgggtccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgtacagacattatttccactctggtggataagttcaataaaggtcatatcccaaactaaaa

SEQ ID NO: 178 - DNA, 2803 bp, Homo sapiens
acacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttccttccaaattaatcccagaccccctaaaatattgacaaccttgacaaccccccaaccgaggagccagactttgttttggactaacttccatagccctatcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacggacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctctgaaaaaaaaaaaaaaaaaa

SEQ ID NO: 179 - DNA, 3425 bp, Homo sapiens
gagacggggtggcggctgcagcccgggtagggccaggagacccggtccacgtttgcaaacgcagccgaacgcccaggccgacccgtgccgcccgagcgccgcgctgcgtccgcgccactcttctcgccgccccgatggcgttccggggctggaggcccccgccgccaccgctgctcctgctgctgctctgggtgaccgggcaggcagcgcccgtggcgggcctgggctccgacgcggagctgcagatcgagcggcgcttcgtgcccgacgagtgcccgcgcaccgtgcgcagcggcgacttcgtgcgctaccactacgtggggacgttccccgacggccagaagttcgactccagctatgacagagactccactttcaatgtgtttgtgggaaaaggacagctgatcacagggatggaccaggctcttgttgggatgtgcgtaaacgagagacgtttcgtgaagattcccccaaagcttgcctacggaaatgaaggagtttctggtgtgatcccccccaattcagtgcttcattttgatgtacttctgatggatatttggaattctgaagaccaggttcagattcacacctatttcaagcccccgagttgccctcggaccatccaggtgtctgattttgtgaggtaccactacaacgggacgttcctggacggaactctgtttgattcgagtcacaatcgcatgaaaacatatgacacgtatgtgggaattggctggctgattcctggaatggataaagggctgctggggatgtgtgtgggtgagaagcgcatcatcaccattcctccttttctggcctatggagaggatggagatgggaaagacattcccggtcaggcatctctggtgtttgatgttgcattattggacctccataaccccaaggacagcatttccattgagaacaaggtagtacctgaaaactgtgagcggataagtcaaagtggggactttctcaggtatcattacaatggcacgcttctggatggcaccctctttgattccagctactctcggaaccgcacgtttgacacgtacattgggcagggctacgtgattcctgggatggatgaaggtctacttggtgtttgcattggagaaaagcgaaggattgtggtcccgcctcacctggggtatggagaggaaggaagagggaatatccccggctcggctgtgctggtgtttgacatccatgtgatcgacttccacaacccttcggactccatcagcatcacctcccactacaaaccccctgactgctcagtgctgagtaagaagggagattacctcaaatatcactacaatgcctcacttctggatgggaccctgctggactccacgtggaatttaggcaaaacttacaatattgttctgggatctgggcaagttgtgttggggatggacatgggtctcagagagatgtgcgttggcgagaaacggacagtgatcattccgcctcacctgggctatggggaagctggcgtggatggagaagtgcccggcagtgccgtattagtgtttgacattgagctgctggagctggtggctggccttcctgaggggtacatgttcatatggaatggtgaggtgtcacccaacctctttgaagaaattgacaaggatggcaacggagaagtcctcctggaagagttctcagagtacattcacgcccaggtggcatctggcaaagggaaactcgctcctggctttgatgctgagctgattgtgaagaatatgttcaccaaccaggaccggaatggagatgggaaggtcacagccgaggaatttaaactcaaagaccaggaagccaaacacgatgaactctaaacctggcatgaaccagatggtgccagggagtacgtgacaccaagccacctgtgtggcaagacgtgcagtgagggtgcaagggtctctcagaagttgcatcattagccagtagtaggtgggtcacatagtacctggtgtacacatcggggtgggttgatatatggggtgagaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaagagggttaaatttttttttaacttgctggttaaaacattttagaaatattctagagatgggcaggagagtcaaagggcttgcttgccccagcagagttcccagcagacagccatggctcttcccagcagcctgtgcaaattctgatgatggccccacccccgcacacgcacacgcacatcatgcttttccagctcatcacaccccgccccactatgggcctaccattaatagtgtataacttggaggttaaaagagccttttggacagaaaactgggccaggaaaaggcatctcagaccacaaatagagaatttgattcctcatttgccacataagtcatctgcttagcttttcctttccttttttttttttttttttttctggaggcagagtctccctttgtcgccaggctggagtgcagtggtgccatctcggctcactgcagcactgtctcggctcactgcagcctccgcctcccgtattcaagcgattctcctgtctcagcctcctgagtagctgggactacaggtgtgcaccaccacgcccggctaatttttgtatttttagtagagacggggtttcactgtgttggccaggatggtctcaatctcgacctcgtgatccgcccaccttggcctcccaaagtgttgggattacaggcgtgactcaccatgcccagccacttagttttttcttattcccacctttctatcccatagaacactcttttttatcttccctgaaccatattgatgagataaatagggctgggggctgggccccgctggtcactcaacagagtatttcccttggccgagatggaagttttgtcccaatagatgagctgctgagcatcaacaaggtgacatttttctgctgcccatttgtgtcctggagacggtggtaccctgaaggcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataaaatgttgaatgatatt

SEQ ID NO: 180 - DNA, 4179 bp, Homo sapiens
ggcggaggcggtgagcgcgggcggcgcggacggcagcggttggcgggcgggtcctccgctgttgcggccgctgcggcctccttgcccgggcttggggcgccgcgctggggaaagccgggggcccggacacattggcgtgagacctgggagtacgttgtgccaaatcattgccacttgccacatgagtgtaaatgatggcggatgccaagtatgtcctctgccgatgggaaaagcgattatggcctgcgaaggttttggcccgaaccgcgacttcaacaaaaaataagagaagaaaggaatattttctagctgtgcaaatcctctctctagaggaaaaaattaaggtgaaaagcactgaagttgagatcctagagaagtctcaaattgaagccattgcttcctcgttagcctcacagaatgaggttcctgcggcacccctggaagaactggcctacagacggtcgcttcgcgtggctctggacgttctgagcgagggctcgatttggagtcaagaaagctctgcagggacaggtagagctgaccggtctctgcgagggaagcccatggagcatgtctcctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaagagtgccagtcttccgaagagtccatggggtctaattccatgcgttctatcctggaggaagacgaggaagacgaggagccaccaagagtccttttataccacgaaccacgttcgtttgaagtaggaatgctagtctggcataaacataaaaaataccccttctggccagcagtggtcaaaagcgtcaggcagagagataagaaagcaagtgtgctatacatcgaaggacacatgaacccgaaaatgaaaggtttcacagtgtctcttaaaagtttaaagcactttgattgtaaagagaaacagacgcttctgaatcaagccagggaggacttcaaccaggacatcggctggtgtgtctccctcatcaccgactacagggtccggttaggctgcgggtcttttgctggctctttcctggaatattacgcggctgatataagctatcctgtccgaaaatccatccagcaggacgtcttggggaccaagcttcctcaactgagcaaggggagccccgaggagcccgtggtggggtgccccctggggcagaggcagccctgccggaaaatgctccccgaccgctcgcgggccgcccgggaccgggccaaccagaagctggtggagtacattgtgaaggccaagggcgcggagagccacctgcgggccatcctaaagagcaggaagccatctcgctggctgcagaccttcctgagctccagccagtacgtgacctgtgtggagacctacctggaggatgaggggcagctggacctggtggtgaagtacctgcagggcgtctaccaggaggtgggggccaaggtgctccagcgcaccaacggcgaccggatccggttcattctggacgtgcttctgcccgaggccatcatctgtgcgatctctgcggtggacgaggtggactacaagacggctgaggagaagtacatcaaggggccttcgctgagctaccgggaaaaagaaatatttgacaaccagctccttgaagagcggaaccggcgccgtcggtgagggagcagccggctgtgctgtcagcggggcctggcggtggaagcgcctccagtgtgcatgagcgtgtctgaagatggggggctcagggggcacgtttgcgtttggacctgtctgtgcgttctcctgcgtggcagtcctgatttccatgcttctggagaatccatttcgttaacactgaaagccagttctcttttcctggcagtttttttcattttatttttggcattttttacaagataccgttcgggaaaggcttttgaaaggacggaagcgtattcactgtgcgccagtactcctggctgtgctgtggtttctcccgacgtgcacatcgatctcgtatgtgtggcatctgatattaaacgggaggttttaagaagcgtctgccgtgatcatggagcttcggaagcgggaatggttcttccgggtttgctgttttgtctgtttcccccttgtgtggtttccgcctgcgacagttccagaatttgctctcccactcagtgtgctctgcagctgtgaggaaacagccttcgttagaggcgggagcagagacgagccgctgctctgtgtcgtgtttgctgtggccgcagggagaggagcaggacacgcacctttccaggggcctctgtgtcccgcactgtgtgtgagtggaccgcagcgcgcagccacatgccctggctgccatgggccagaccgcctccacctcccccgcccgcctggcctgtcctgagtgcatttccctgcactgtgtcgtcactgcacagccagtcaccgcggtctcagtcatcggcgcggatggctatgctggggtcccagggtggccgcagcagtcagggtcactgtgggagccctggggtggagtgacaaaccgcattgtcctgtgcccgccatggcagaagcgcagcctttgtatggaggcccaaccgcgctcccgtctggagaagcggcttccggggtgtggctgccgggtcggctctggtccacagcacggtgccggggctgcaggttgttgagggctgtgactccgtggggctcagccaggctccagcagggtcagacgtgctgttaagagcaaagccacagacgatgacttgtccattctcagtggatgctccaggctgtgcctacacagcagtgctggtgacatgtccagggttccagggcccggtggcctgggagctgctttctccccactggctgggctgcatctggccctggctggaggccttgctttgaggggctgtgaccctcttcccccaggccctccccagccgacgacagccaccggagaggagatcggaacacgattgtctcagatgcagggcgctgtgcgggacgaagccgcaaggactctcgtatcgggcccttgggactcgggaggtgccagaggcggcggctgctctggacctcggtgttcactgacctttgtttcacttgcctctgctcgactccgagagcaggaaacccggccgtggcctggcagctccgcctcccatgcccgcacgctggggtctgtcttgtctggagcagtggggcacaccccggaggaggcgggggtcagggctgtcggccttggccccctgctggtcgctgtttcggggactcggggcggccagtaccaccgcctgaggcggggctcagcagcgttgcatgtacgggcctcgtactgcctcatggaaaatcctccggagccgccctccattgtgggttcctgagagtaggacacattgccatggttttgtgggaatcacgcgcccctgatggaacttttctgctgttgtgaagtacttttatccatttgcttctctgctgaccttgccaagttgttcgaggtggaattaaacacctcccagac

SEQ ID NO: 181 - DNA, 847 bp, Homo sapiens
gcgagcggcttccgccgggctgctccgcgggcgcgtcggccatgagcgagttgccgggcgacgtgcgggcgtttctgcgggagcacccgagcctgcggctccagacggacgcccgcaaggtgaggtgcatcctgacaggtcacgagctgccctgccgcctgccggagctccaggtctacacccgcggcaaaaagtaccagcggctggtccgcgcctccccggccttcgactatgcagagttcgagccgcacatcgtgcccagcaccaagaacccgcaccagttgttctgcaaactcaccctgcggcacatcaacaagtgcccagaacacgtgctgaggcacacccagggccggcggtaccagcgagctctgtgtaaatatgaagaatgtcagaagcaaggggtggagtacgtgcctgcctgcctggtgcaccggaggaggaggagggaggaccagatggacggtgacgggcctcgcccgcgggaagccttctgggagcccacatccagtgatgaggggggagctgcaagtgatgacagcatgacagacctgtacccacctgagctattcaccagaaaggaccttggaagcacggaggatggggatggcactgatgactttttgacagacaaagaggatgagaaggcaaagcccccaagagagaaggccactgatgagggcaggagagagacgaccgtgtaccgagggctggtccagaagcgcgggaagaagcagttgggctcgttgaaaaagaagttcaagagtcatcaccgcaaacccaagagcttcagctcctgtaaacagccaggttaataaaagcacatgccgtgaaaaaaaaaaaaaaaaaa

SEQ ID NO: 182 - DNA, 2140 bp, Homo sapiens
cgggccctgggcggggccttcccggctgacggcctgcgtgcactgcgcttgcgcgggttgagggcggtggctcaggctcctggaaaggaccgtccacccctccgcgctggcggtgtggacgcggaactcagcggagaaacgcgattgagaaatggaaaagaaaatgaaataaatcagcagttatgaggcagagcctaagagaactatggcaacatcaggtgactgtcccagaagtgaatcgcagggagaagagcctgctgagtgcagtgaggccggtctcctgcaggagggagtacagccagaggagtttgtggccatcgcggactacgctgccaccgatgagacccagctcagttttttgagaggagaaaaaattcttatcctgagacaaaccactgcagattggtggtggggtgagcgtgcgggctgctgtgggtacattccggcaaaccatgtggggaagcacgtggatgagtacgaccccgaggacacgtggcaggatgaagagtacttcggcagctatggaactctgaaactccacttggagatgttggcagaccagccacgaacaactaaataccacagtgtcatcctgcagaataaagaatccctgacggataaagtcatcctggacgtgggctgtgggactgggatcatcagtctcttctgtgcacactatgcgcggcctagagcggtgtacgcggtggaggccagtgagatggcacagcacacggggcagctggtcctgcagaacggctttgctgacatcatcaccgtgtaccagcagaaggtggaggatgtggtgctgcccgagaaggtggacgtgctggtgtctgagtggatggggacctgcctgctgtttgagttcatgatcgagtccatcctgtatgcccgggatgcctggctgaaggaggacggggtcatttggcccaccatggctgcgttgcaccttgtgccctgcagtgctgataaggattatcgtagcaaggtgctcttctgggacaacgcgtacgagttcaacctcagcgctctgaaatctttagcagttaaggagtttttttcaaagcccaagtataaccacattttgaaaccagaagactgtctctctgaaccgtgcactatattgcagttggacatgagaaccgtgcaaatttctgatctagagaccctgaggggcgagctgcgcttcgacatcaggaaggcggggaccctgcacggcttcacggcctggtttagcgtccacttccagagcctgcaggaggggcagccgccgcaggtgctcagcaccgggcccttccaccccaccacacactggaagcagacgctgttcatgatggacgacccagtccctgtccatacaggagacgtggtcacgggttcagttgtgttgcagagaaacccagtgtggagaaggcacatgtctgtggctctgagctgggctgtcacttccagacaagaccccacatctcaaaaagttggagaaaaagtcttccccatctggagatgacagttgatgctttatttggaaagcagtgtgcatatcttgaggggtgatgaacacaagcaaaccaagttgcacctggcttctgcacactcctgcgaaagtcggtgaacattcactccacattgacccctccctagcctggcaggtgacgtcagggtccttcacagacaaacacgcttgggctcggcaggagctgccgtggccacccccgctgcccagtgtctgccctctagaagtaggctgtgtttccaggtgttcacccgtggtgcccacagtgccgacccgtggctgggtcggagctccatgttcctaagctaggtctaggtctacactcctaggacgcacgcatatcagcccgtgtaccctgtgacagtgactgtccccacctcctatgttagtggtgcccttactgccgtcgctcatccactcgtgtgggacgtaggattgcacagggctgtgccagtggcgtgtagggaacactgccctggctcagcgtgcgagctaaggtggtgatgtatgcgatgggactctgcatgggatagtacagttgtgtagacgtcttccaaataaattatgtgttggtccatcgcacatgctcaataaatatttttaaatgagtgaatgtcaaaaaaaaaa

SEQ ID NO: 183 - DNA, 3762 bp, Homo sapiens
agagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaagactgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatatgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaa

SEQ ID NO: 184 - DNA, 3256 bp, Homo sapiens
cggcggcggcggcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggagtcataccctgctgtgccccccatctggtcggtggagtctgatgaccctaacttggctgctgtcttggagaggctggtggacataaagaaagggaatactctgctattgcagcatctgaagaggatcatctccgacctgtgtaaactctataacctccctcagcatccagatgtggagatgctggatcaacccttgccagcagagcagtgcacacaggaagacgtgtcttcagaagatgaagatgaggagatgcctgaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatggtgcagtgtctggctcggtgcaggccactgaccggctgatgaaggagctcagggatatataccgatcacagagtttcaaaggcggaaactatgcagtcgaactcgtgaatgacagtctgtatgattggaatgtcaaactcctcaaagttgaccaggacagcgctttgcacaacgatctccagatcctcaaagagaaagaaggagccgacttcattctacttaacttttcctttaaagataactttccctttgacccaccatttgtcagggttgtgtctccagtcctctctggagggtatgttctgggcggaggggccatctgcatggaacttctcaccaaacagggctggagcagtgcctactccatagagtcagtgatcatgcagatcagtgccacactggtgaaggggaaagcacgagtgcagtttggagccaacaaatctcaatacagtctgacaagagcacagcagtcctacaagtccttggtgcagatccacgaaaaaaacggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagtaaagaaaaaaaaaaaaaaaaaaaaaaaaaaaaa

SEQ ID NO: 185 - DNA, 3832 bp, Homo sapiens
cggcggcggcggcgcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgaccccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcttctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggagctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcaaatcggcatcctgaagccgcacccggcctacgtgcagctgctggagaaggccgcggaacccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccgtatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccaccccccaaaaaaaaaaaaaaaaaaaaaaaaaaaaaaaaaaaaaaaaaaaaaaaaaaaaaaaaa

SEQ ID NO: 186 - DNA, 3110 bp, Homo sapiens
gcggaagtggagctaccgccaccgccgccgccgattccggagccggggtagtcgccgccgccgccgccgctgcagccactgcaggcaccgctgccgccgcctgagtagtgggcttaggaaggaagaggtcatctcgctcggagcttcgctcggaagggtctttgttccctgcagccctcccacggcagagtctccagagatttgggccgctacaaaaagtgcattttgcccattcggctgtggatagagaagcaggaagagcactggacttggagtcagggaatgacaatggataaaagtgagctggtacagaaagccaaactcgctgagcaggctgagcgatatgatgatatggctgcagccatgaaggcagtcacagaacaggggcatgaactctccaacgaagagagaaatctgctctctgttgcctacaagaatgtggtaggcgcccgccgctcttcctggcgtgtcatctccagcattgagcagaaaacagagaggaatgagaagaagcagcagatgggcaaagagtaccgtgagaagatagaggcagaactgcaggacatctgcaatgatgttctggagctgttggacaaatatcttattcccaatgctacacaaccagaaagtaaggtgttctacttgaaaatgaaaggagattattttaggtatctttctgaagtggcatctggagacaacaaacaaaccactgtgtcgaactcccagcaggcttaccaggaagcatttgaaattagtaagaaagaaatgcagcctacacacccaattcgtcttggtctggcactaaatttctcagtcttttactatgagattctaaactctcctgaaaaggcctgtagcctggcaaaaacggcatttgatgaagcaattgctgaattggatacgctgaatgaagagtcttataaagacagcactctgatcatgcagttacttagggacaatctcactctgtggacatcggaaaaccagggagacgaaggagacgctggggagggagagaactaatgtttctcgtgctttgtgatctgttcagtgtcactctgtaccctcaacatatatcccttgtgcgataaaaaaaaaaaaaaaaaaaaaaagagaatcgtacgtcgactttcgatttttcacagcctcagcctaggaaaaatggttcatgggataaacagctggtatttgtatctaaaactcagattggtcacataaatgccacggcattccgaagttttgattttgattaacattgacaggattactgtgtgtttaattttttaaaaactgaacactgtgattatggggttttgtaatttagcagaactcttactggtagaaaaaatagacctgaattatgtgtaactttttggaaggtttaatctgatatcaaaataatcattgaaatacaattccattgtaaagttgtacagaaagttatagagattatattgtgatgctggaacttggagtgagacacacatcatttggcatttgagttgaatggtaattcacagtaatgctgccgttgttcgggacttaaagacacttgacctgtttgggctgttgccacttaaaagttcatgaccacaaatgtccacagtgtcttcctctgaggaaactcgaatcctgaaatggaaattctttgtggcagataactggcttatgacaccttgaaaagttcaagtgctcatataacacaccacactgaaccccctttcctacagcaatatgttcactatgttaccaatttgcaacttgtgcttcaatagtggaatctactttcattgttaacactgagctaaagaaaaaaagccgtgtgttttatgaatgaccttatctgtttcctggataatacctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaaaaagaaaacaaaaaacaaaaaaaggaatgatgttctgtagagatggcctttcacttgaggagtactcagttttcaggttcttcctagctcggggcttttaaattttgaaatctaaacattctttcccaccatcctttttgactgttgaccttggttttctcttctaagtttctgtccctctgcttccttactttttttcctttttgaattctatctttatctgtcttttgttcactttttaatgctatatatgggcaggggtgagagacattactgagcaccttggtgagcaagcctggctttaaagattggagaagagcttctggcaccagaaccctgtcttcctccagttctcaacacggtgttgctcttcagtcataccggaatctgaatcaaaaaagtatttttaaatatccatgatttctccctgtattgaggctagccctgatcatgctttttgtgcctgtcaccaggtctcccaagtgcactcatccaggtcagtgctcagatgtgtttaaggagaccctatattcagggaagttgcgtgaacactgcagtggggagaattgagaatagtcaggcctatcagtctcacagaatcacccctctacctttgatattccacttagctgtagagtccatctgtttgtccatctgctgaaatgagaaaagaaaaatttatgcactgatttaaaacaaaccaaaaaaaaagaaaaaaacaaaaaaaaaaatccctcctttctagctgaacaaaaatgtgcagttaatacttggcgcttgaaaatgcagtagtgaatgtggaaccaagcctgtctgtatatctggtagctcttttcttgctttgttttttcttaccagtattctgcctaacgtttgcttctgtgatggttatattgcctagcaagcacacccgtggttgtgaaaatagtatagcaaaaaagaaaaatccccggttattgatgtactagatttgtgtatgtcttttaaacagttctagtttcaccttacacagaataatcaggaaaagtgtaaaaattcaaaagtgaaataaaaattttatcagttaaaaaa

SEQ ID NO: 187 - DNA, 607 bp, Homo sapiens
gtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttacaaaaaaaaaaaaaaaa

SEQ ID NO: 188 - DNA, 602 bp, Homo sapiens
ggaagcagcgggcagcggcccgcggagaggcacctcggagatctgggtgcaaaagcccagggttaggaaccgtagcatgctgcgccccaaggctttgacccaggtgctaagccaagccaacactggaggcgtccagagcaccctgctgctgaataacgagggatcactgctggcctactctggttacggggacactgacgcccgggtcaccgctgccatagccagtaacatctgggccgcctacgaccggaacgggaaccaagcgtttaatgaagacaatctcaaattcatcctcatggactgcatggagggccgtgtagccatcacccgagtggccaaccttctgctgtgtatgtatgccaaggagaccgtgggctttggaatgctcaaggccaaggcccaggctttggtgcagtacctggaggagcccctcacccaagtggcggcatcttaacggcattggtggaagctggggtcagaaaagagaaatgaccatttggaggggcggtgcctcctagaagaaccttcttagacaatggggggaggatgggactttgttttttccaagaataaactcaactcctgcatgaaaaaaaaaaaaa

SEQ ID NO: 189 - DNA, 2334 bp, Homo sapiens
ctttatggcgtgggagaggccacagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagcttcaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcgagttacaaacgtcttaatcactcctggaaaaagtcagatggatctgcggaaactgcttagaaaagtcgatgtagagaggaggccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccataacaaatacagataaaaacacccagctgggtgcagtggctcgcacctgtaatcccagcactttgggaggctgaggcaggtggatcacctgaggtcgggagtttgagaccagcctggccaacatggtgaaatcccatctctactgaaaatacagaattggccgggtgtggtgtcacgcgcctgtggtcccagttacttgaacctgggaggcggaggttgcagtgagccgagattgcaacactgccactccagcctgggtgacagagcaagagaccctgtctcaaaaaaaaaaaaaaaaaaattaaatgggtagtgacgttaagagatatatatcagcttctagtaaaagtttttttttttaaacctgctagctacatttacattatgtaaaaataaatggaataatcactgagaataaagcagttgagtatttataacaataatattttatggggcgcttataatgtttataatattgtaaaccactgtgtactctattcatttaatgctaaatgacttgaccattcttgtgggataagagatcattaaaaaaatgctagggccgggcaccatggctcacgcctgtaatcccaggactttaggaggccaaggcaggtggatgacttgagctcaggagtttgagaccagcctgggcaacatgatgaaaactccgtctctaccaaaaatcaaaaaaattagccaggtgtgatgttgtgcgcctgtagtcccagctacttgtgaggctgaggtgggaggatggtttgggccccggaggtagaggttgcagtgagctgagattgtgccactgtattccatcctgggcaacagagccagaccctgcctcaaaaaaaaaaaaaaaaaaaaaaaggcctggcacagtggctcacgcctgtaatcccagcactttgggaggctgaggcgggcaaaacacttgaggtcagacgtttgagaccagcctggccaacatggtgaaaccccgtctctaccaaaaataaaaataaaaattatccaggcgtggtggcatgtgcctatagccccagctactcaggaagctagagcacgagaattatgtgcatcctggaggtgaaggttgcagtgagccaagatcacaccactccactccagtctggacaacagagtgagaccctgtgtc

SEQ ID NO: 190 - DNA, 3032 bp, Homo sapiens
aacacgattcctctggccaggccaaggggagggcgacactgacaggcgccccccacccaggggccgtggcgaagcaaggggccggctgctcagaaaaggataagaagtggtttctcctcccctcttcccttcctcatcctgcagcccgcgcctcccccctcgccgcgctgcgcacggatggcggcgggagccgcagagccaccatgttcagccagcagcagcagcagcagctccagcaacagcagcagcagctccagcagttacagcagcagcagctccagcagcagcaattgcagcagcagcagttactgcagctccagcagctgctccagcagtccccaccacaggccccgttgcccatggctgtcagccgggggctccccccgcagcagccacagcagccgcttctgaatctccagggcaccaactcagcctccctcctcaacggctccatgctgcagagagctttgcttttacagcagttgcaaggactggaccagtttgcaatgccaccagccacgtatgacactgccggtctcaccatgcccacagcaacactgggtaacctccgaggctatggcatggcatccccaggcctcgcagcccccagcctcacacccccacaactggccactccaaatttgcaacagttctttccccaggccactcgccagtccttgctgggacctcctcctgttggggtccccatgaacccttcccagttcaacctttcaggacggaacccccagaaacaggcccggacctcctcctctaccacccccaatcgaaaggattcttcttctcagacaatgcctgtggaagacaagtcagaccccccagaggggtctgaggaagccgcagagccccggatggacacaccagaagaccaagatttaccgccctgcccagaggacatcgccaaggaaaaacgcactccagcacctgagcctgagccttgtgaggcgtccgagctgccagcaaagagattgaggagctcagaagagcccacagagaaggaacctccagggcagttacaggtgaaggcccagccgcaggcccggatgacagtaccgaaacagacacagacaccagacctgctgcctgaggccctggaagcccaagtgctgccacgattccagccacgggtcctgcaggtccaggcccaggtgcagtcacagactcagccgcggataccatccacagacacccaggtgcagccaaagctgcagaagcaggcgcaaacacagacctctccagagcacttagtgctgcaacagaagcaggtgcagccacagctgcagcaggaggcagagccacagaagcaggtgcagccacaggtacagccacaggcacattcacagggcccaaggcaggtgcagctgcagcaggaggcagagccgctgaagcaggtgcagccacaggtgcagccccaggcacattcacagcccccaaggcaggtgcagctgcagctgcagaagcaggtccagacacagacatatccacaggtccacacacaggcacagccaagcgtccagccacaggagcatcctccagcgcaggtgtcagtacagccaccagagcagacccatgagcagcctcacacccagccgcaggtgtcgttgctggctccagagcaaacaccagttgtggttcatgtctgcgggctggagatgccacctgatgcagtagaagctggtggaggcatggaaaagaccttgccagagcctgtgggcacccaagtcagcatggaagagattcagaatgagtcggcctgtggcctagatgtgggagaatgtgaaaacagagcgagagagatgccaggggtatggggcgccgggggctccctgaaggtcaccattctgcagagcagtgacagccgggcctttagcactgtacccctgacacctgtcccccgccccagtgactccgtctcctccacccctgcggctaccagcactccctctaagcaggccctccagttcttctgctacatctgcaaggccagctgctccagccagcaggagttccaggaccacatgtcggagcctcagcaccagcagcggctaggggagatccagcacatgagccaagcctgcctcctgtccctgctgcccgtgccccgggacgtcctggagacagaggatgaggagcctccaccaaggcgctggtgcaacacctgccagctctactacatgggggacctgatccaacaccgcaggacacaggaccacaagattgccaaacaatccttgcgacccttctgcaccgtttgcaaccgctacttcaaaacccctcgcaagtttgtggagcacgtgaagtcccaggggcataaggacaaagccaaggagctgaagtcgcttgagaaagaaattgctggccaagatgaggaccacttcattacagtggacgctgtgggttgcttcgagggtgatgaagaagaggaagaggatgatgaggatgaagaagagatcgaggttgaggaggaactctgcaagcaggtgaggtccagagatatatccagagaggagtggaagggctcggagacctacagccccaatactgcatatggtgtggacttcctggtgcccgtgatgggctatatctgccgcatctgccacaagttctatcacagcaactcaggggcacagctctcccactgcaagtccctgggccactttgagaacctgcagaaatacaaggcggccaagaaccccagccccaccacccgacctgtgagccgccggtgcgcaatcaacgcccggaacgctttgacagccctgttcacctccagcggccgcccaccctcccagcccaacacccaggacaaaacacccagcaaggtgacggctcgaccctcccagcccccactacctcggcgctcaacccgcctcaaaacctgatagagggacctccctgtccctggcctgcctgggtccagatctgctaatgctttttaggagtctgcctggaaactttgacatggttcatgtttttactcaaaatccaataaaacaaggtagtttggctgtgca

SEQ ID NO: 191 - DNA, 6138 bp, Homo sapiens
acttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttcttttttttttttttttttactaaattagagaactgctcttgctgaaattatgatagttaagattcctaagaacttgacaatgctcccctggcttgcaggaaattatacttattatagcatcaccaagtttagaaatcatcactaattttcaccctctgttgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaaaaaaaaaaaaaaaaaa

SEQ ID NO: 192 - DNA, 4658 bp, Homo sapiens
ggaattccgggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggttctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgccaacctgaagccatctgaattaaaaaaagatacatgctactctccaaagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggaaagaactggaaaaactgcgaaaagatttggaagaagagaagacaatgagaagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgctcagtagtttttttattgaaacttgtattatttttaaagagatctatactataaatatggtgatatatttacaagtaatctgtaagatatactatttgagagggacagattagccttttagtaactatagtcactactttttccataatgcataagggatataaactctgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaaaaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcaaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatattgaacatattttaaaatacatttcacagaatggatgaattagttgtttcttcaaaagttacttatgaacagttgaatgcctttaaaatgttctgtctgtaggtacatctaaaaacacaagtgggtttatttaaatttttaaaatttgaaattttttatttgccaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgttaatgaaattttgtcatgtttcaaataaagaaaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttctccttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatactcttacctttctgtccttgataaaatagtaaagaaaaccaaacaaacccaggcctgatgggaaaaatgattcctttattctagcaattactttctgttggtatgggaaatgttattaatttctattactaaagttcatatcacaaaatgatatttaataataaccttggggtaaatcatgaatttttttttctacgtgtgagtataaaagacaaaagttgaacagcatggaatcttcattgccaaattattagtgaatgtatagttcaggtattctttgagacacacagtatcattaatttccgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatccggaattc

SEQ ID NO: 193 - DNA, 2755 bp, Homo sapiens
gtgttgctcctcccctggcagccgtgaggggggttagatctcagccggagccggagctgggcctagctgtcccacgggccaccactacctcctttggttcgggagaaagctacgaccaagtacgcccagctcgggccttagaacttctgaacgggcagtgcgggtaggccctgcttagcccttcccggaggacacctgaccaaaagaggaagatagtcttgggacccttgcatggtgtttcaaagggtggtgaagaactaaggtagaagaatacatgttcacttccagtgaacaagagcatgttcccaaactcaattttgggtcacccacccttcactccaaatcatcaacaacataataacttctttaccctgtcacctactgtttattcacaccagcagcttatagatgcacaattcaactttcagaatgcagacttgtctagagctgtgtcattacagcagctgacatatggaaatgtcagtccaatacagacctcagcttccccattatttcgaggaaggaagagattaagcgatgaaaaaaaccttcctcttgacggtaaacggcaacgtttccattcaccccaccaagagccaactgtagttaaccagatagtgcctttatcaggtgaacgaagatactcaatgccaccattgtttcatacacattatgtaccagatatagtcagatgtgttccaccttttcgagaaattgcatttttagaacctagagaaatcacactgcctgaggccaaagataagttgagtcagcagatactggagttatttgaaacatgtcagcagcaaataagtgatttaaagaagaaagaactctgtcgaacacagctgcagagagaaattcagctgttatttccacaaagcagactttttttggttgggtcctctttaaatggatttggtacccggagcagtgatggtgatttatgcctagttgttaaggaagaaccatgtttttttcaggtaaatcagaagactgaagcacggcatatactcaccttagtccataaacacttctgtactagactttcgggctacattgagagacctcagctgattcgagcaaaagtgccaattgtgaagttcagggataaagtcagttgtgtggagtttgacttgaatgtaaacaatattgttggaataagaaacacattccttctcagaacttatgcataccttgaaaatcgagttcgtccgttagtgctggtgattaagaagtgggcaagtcaccatcagataaatgatgccagtcgtggtactttaagcagctatagtcttgtattgatggttttgcactatttacaaaccctacctgaacccatccttccatccctccaaaaaatttacccagagtcttttagtcctgctatacagctgcaccttgtacatcaagctccatgtaatgttcctccttacctctcaaagaatgaatcaaaccttggggacctcttactgggctttcttaaatattatgctacagaatttgactggaatagtcaaatgatttcagttcgtgaagccaaagccattccaaggcctgatggtattgaatggagaaataaatacatctgtgtagaagaaccttttgatggaacaaatacagccagagcagtgcacgaaaagcagaaatttgatatgatcaaggatcaatttttaaagtcatggcacagattgaaaaacaagagagatttgaacagtatactacctgtaagagctgctgtcctgaaaagataactggcctctatttcttaataaattcttccaagaaataaagaacaatagtttcatcataatacattatgtttacctccatcatagttgcttttttcatagttcttgttttcatgttttatttttaaaaagacatataaagattgcatattttattatgacatttcctaataaacccctttgatttaaaaatgtatttttaaaaatgtttacattgatgatgagtaatattgcatgtgttttcaggtgatcagataaaatatattttgggaaattaacaaataaaaagtttttgatataacttcaattaattgtaccacatgctaatcctgaagagatgtgtagaattttggaaagggtctaattcatacatgcttaaagtataacctacgttagatagtttgttgtcaaagtctgttctagtaaagtgaagattcaagtcagttgttcatttacttgaagcaaaacgaaatctttcatttcagtcaaatcactgcagtcatgaaatactgaacaattgccttaagtctttgcttgactcactgggatagactgaggctttgggtgtgtctgtattagcatttcattagtacttcacatgcttttgatgtactcttgagattgctttaaattttgtattgaaacaacaatacattttgcactgtagtaatgggagcactaactcttacaacagttagtgaatcgttttaaagaatcagttcagtgtagacattttgaaaagattgtttcctgtgctttacgatagcttagtgcaatgtgcacttctgttttacttgccattttcctgctctgttttctctgtgacatgaagcaacagaaactgagatcaaagttaagattatatcctgtttgtagtatcagatatttttctgtgtacaattataggattgtaatctaaactggaatttttaggcagtaagtcaccacaaaatgttttagataagacacaataaaattattataaataaaagcttaatgtttgt

SEQ ID NO: 194 - DNA, 1110 bp, Homo sapiens
ctttccgctcggctgttttcctgcgcaggagccgcagggccgtaggcagccatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggcaaggttgggctggtgctcacagctgtaatcccagcactttgaggttggctgggagttcaagaccagcctggccaacatgtcagaactactaaaaataaagaaatcagccatgaaaaaaaaaaaaaaaaaaaaaaaaa

SEQ ID NO: 195 - DNA, 2798 bp, Homo sapiens
gccctctcccacagcggagtccaaaacaggcctaccagtcagttcttatttctattgggtgtttccatgctccaccatgttaagagctaagaatcagctttttttactttcacctcattacctgaggcaggtaaaagaatcatcaggctccaggctcatacagcaacgacttctacaccagcaacagccccttcacccagaatgggctgccctggctaaaaagcagctgaaaggcaaaaacccagaagacctaatatggcacaccccggaagggatctctataaaacccttgtattccaagagagatactatggacttacctgaagaacttccaggagtgaagccattcacacgtggaccatatcctaccatgtatacctttaggccctggaccatccgccagtatgctggttttagtactgtggaagaaagcaataagttctataaggacaacattaaggctggtcagcagggattatcagttgcctttgatctggcgacacatcgtggctatgattcagacaaccctcgagttcgtggtgatgttggaatggctggagttgctattgacactgtggaagataccaaaattctttttgatggaattcctttagaaaaaatgtcagtttccatgactatgaatggagcagttattccagttcttgcaaattttatagtaactggagaagaacaaggtgtacctaaagagaaacttactggtaccatccaaaatgatatactaaaggaatttatggttcgaaatacatacatttttcctccagaaccatccatgaaaattattgctgacatatttgaatatacagcaaagcacatgccaaaatttaattcaatttcaattagtggataccatatgcaggaagcaggggctgatgccattctggagctggcctatactttagcagatggattggagtactctagaactggactccaggctggcctgacaattgatgaatttgcaccaaggttgtctttcttctggggaattggaatgaatttctatatggaaatagcaaagatgagagctggtagaagactctgggctcacttaatagagaaaatgtttcagcctaaaaactcaaaatctcttcttctaagagcacactgtcagacatctggatggtcacttactgagcaggatccctacaataatattgtccgtactgcaatagaagcaatggcagcagtatttggagggactcagtctttgcacacaaattcttttgatgaagctttgggtttgccaactgtgaaaagtgctcgaattgccaggaacacacaaatcatcattcaagaagaatctgggattcccaaagtggctgatccttggggaggttcttacatgatggaatgtctcacaaatgatgtttatgatgctgctttaaagctcattaatgaaattgaagaaatgggtggaatggccaaagctgtagctgagggaatacctaaacttcgaattgaagaatgtgctgcccgaagacaagctagaatagattctggttctgaagtaattgttggagtaaataagtaccagttggaaaaagaagacgctgtagaagttctggcaattgataatacttcagtgcgaaacaggcagattgaaaaacttaagaagatcaaatccagcagggatcaagctttggctgaacattgtcttgctgcactaaccgaatgtgctgctagcggagatggaaatatcctggctcttgcagtggatgcatctcgggcaagatgtacagtgggagaaatcacagatgccctgaaaaaggtatttggtgaacataaagcgaatgatcgaatggtgagtggagcatatcgccaggaatttggagaaagtaaagagataacatctgctatcaagagggttcataaattcatggaacgtgaaggtcgcagacctcgtcttcttgtagcaaaaatgggacaagatggccatgacagaggagcaaaagttattgctacaggatttgctgatcttggttttgatgtggacataggccctcttttccagactcctcgtgaagtggcccagcaggctgtggatgcggatgtgcatgctgtgggcgtaagcaccctcgctgctggtcataaaaccctagttcctgaactcatcaaagaacttaactcccttggacggccagatattcttgtcatgtgtggaggggtgataccacctcaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaatccctaaaaactctctatactctctataacaatactttatcaagaactctggacaatggtattatttttaaaaatcatggtgatgtatttattagaatgtttcttataaatctctttcatttttatattaagaattaaactgtacctaaaaaaactctgactattcccatttctcagtttagcattacattgtcttgagcaccagaaaataaaatccatatattaattaaaacctatcttgaaaaaaaaaaaaaaaaaaaaaaaaaaaa

SEQ ID NO: 196 - DNA, 1897 bp, Homo sapiens
ggcacgagggtcttcttcggtggcgatccgcgtcctagaaagggcggtgggctccacctcggcctagaaggccagcgggagccgtaggaagccgtcgcgggaagctcagccgaattggagttggagcccccggattgcgctgaccctgagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtgaagaaagccctgtgtgtcctcgtccaacataacctggtgagttatcaagtgcacaaacgtggtgtggtggagtatgaagcccagtgcagccgggtattgcgaatgcttagatatccccggtacatctatactaccaaaactctgtacagtgacactggagagctgattgttgaggagcttctgttgaacggcaaactgacaatgtcagctgttgtgaagaaagtggcagaccggctcacagagaccatggaggatggcaagaccatggactatgctgaagtatcaaacacatttgtgcgactggcagacacacactttgtacaacgctgcccttcggtacctaccactgagaattcagaccctgggccaccaccacctgcccccacacttgtcattaatgaaaaggacatgtacctggttcctaaactcagcttgatagggaaaggtaaaaggaggagatcatctgatgaagatgctgctggggagcccaaggccaagagaccaaaatatactacagataacaaggagcccattccagatgatgggatttattggcaggccaaccttgacagattccaccaacacttccgtgaccaagccattgtgagcgcagttgctaacaggatggaccagacaagcagcgagattgtgcgaaccatgctccgaatgagtgagattaccacttcctctagtgctcccttcacccagccattgtcttccaatgagatcttcagatccctacctgttggctataacatctctaagcaagttcttgatcagtatctcactctgctggcagatgatccactagagtttgttggaaagtctggcgacagtggtggaggaatgtatgtcatcaacctccataaggcattagcatccctagccacagccactctggagtccgtcgtacaggagagatttgggtctcgctgtgctagaatattccgtctagttttgcagaagaaacacatagagcagaagcaagtggaagactttgcaatgattcctgcaaaggaggcaaaggatatgctatataagatgctctcagaaaatttcatgtcactccaggaaattcccaaaacaccagaccatgccccatccaggaccttctatttatatactgtgaacatcctgtcagctgcccgaatgttgttgcacaggtgctacaagagcatagccaacttgatagaaaggaggcaatttgaaaccaaagagaataagcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagttggatgccagtgagatccaggtggacgaaaccatcttcctgctggagtcttacattgagtgcaccatgaagagacagtgatccagaagaagcatcttcctcagaagatctggggggatggaaagcaaaataaaggaggtgcctggatgcattatttgcagtgggaaaaaaaaaaaaaaaaaaaaaaaaaaaaaaaaaaaaaa

SEQ ID NO: 197 - DNA, 1142 bp, Homo sapiens
cttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaaaaaaaaaaaaaaaaa

SEQ ID NO: 198 - DNA, 1590 bp, Homo sapiens
acacagcttctccactggatcatcggtggcgatgaaggggcggctggggaaggatgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctgccaagcagaggctcccgtgcaggaagagaagctgtcagcaagcacctcaaatttgccatgctggctggtggaagagtttgtggtagcagaagagtgctctccatgctctaatttccgggctaaaactacccctgagtgtggtcccacaggatatgtagagaaaatcacatgcagctcatctaagagaaatgagttcaaaagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaaaaaaaaaaaaaaaaaa

SEQ ID NO: 199 - DNA, 2870 bp, Homo sapiens
gcccggcaggttggcggaccggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcctactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaatgaatgttaaaaacagactcagctgtttctttccttttactactaccagttgctcccatgctgctccaccaggccctgtttcggatgccaactggcccactccccaagcacttgcccccagcttgcgaccattggcactgggagggcctggcttctgggctgatgggtcagttgggccttcataaacactcacctggctggctttgccttccaggaggaagctggctgaagcaagggtgtggaattttaaatgtgtgcacagtctggaaaactgtcagaatcagttttcccataaaagggtgggctagcattgcagctgcatttgggaccattcaaatctgtcactctcttgtgtatattcctgtgctattaaatatatcagggcagtgcatgtaaatcatcctgatatatttaatatatttattatattgtcccccgaggtggggacagtgagtgagttctcttagtccccccagagctggttgttaaagagcctggcacctacccgctctcacttcatctgtgtcatctctgcacactccagcccactttctgccttcagccattgagtggaagctgccccaggcccttaccaggtgcagatgcccaatcttgatgcccagccatcagaactgtgagccaaataaacctttttctgtataaaaaaaaaaaaaaaaaaaa

SEQ ID NO: 200 - DNA, 3075 bp, Homo sapiens
acttccgccccggaaagcgaggccgccaccatcttttgggtccgggaggattgagtcatcgggctccaatgcgtggggatgtttaccgccgtttatccgggatagagactccatcgtgctgacagcatccttttattcaccgcctccgaatttgcaaagaggaggaaggagggacttcttggcttctcccagcatagccccagttatgccatctcagaactatgaccttccccagaagaagcaggagaaaatgaccaagtttcaggaggctgtgacattcaaggatgtggctgtggtcttctccagggaggaactgcgactgctcgatcttacccagaggaagctgtaccgagatgtcatggtggagaacttcaagaacctggttgcagtggggcatcttcccttccaaccagatatggtatcccaattggaagcagaagaaaagctttggatgatggaaacagaaacccaaagaagcagcaagcatcaaaataagatggaaacactccaaaaatttgcattaaaatacctttcaaatcaagagctgtcctgctggcaaatctggaaacaggttgcaagtgaattaaccaggtgtcttcaggggaagagttcccagttattacaaggtgactctattcaggtttctgaaaatgagaacaatataatgaaccctaaaggagatagctctatttatattgaaaatcaagagtttccattttggagaacccagcattcttgcgggaatacatatctgagtgagtcacagattcagagtagaggtaagcaaattgatgtgaaaaataacctgcaaatacatgaagacttcatgaagaaatcaccatttcatgagcatattaaaactgacacagaaccaaaaccctgcaaaggtaatgaatatggcaaaatcattagtgatggctccaaccagaaattacccttaggagagaaaccccatccatgtggtgagtgtggaaggggcttcagttatagcccaaggcttccccttcatccgaatgttcacacaggagaaaaatgcttcagtcaaagctcacatctgcgaactcatcagagaattcacccaggagagaaactcaatagatgtcatgaatctggtgattgcttcaataagagctcttttcattcttatcaatctaatcatacaggagagaagtcttatagatgcgacagttgcggcaagggattcagtagcagcacgggtcttatcattcattacagaactcatactggagagaaaccctataaatgcgaggaatgtggtaaatgctttagtcaaagttcaaattttcagtgccatcagagagtccacactgaagaaaaaccatacaaatgcgaagagtgtggtaagggcttcggttggagtgttaatctccgtgttcaccagagggtccacaggggtgagaagccctataaatgtgaggaatgtggtaagggcttcactcaggctgcacattttcacatccatcagagagtccacactggagagaaaccctacaagtgtgatgtgtgtggtaagggcttcagccacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgtaaaaaaaaaaaaaaaagaaaaaaaaaaaaaaaa

SEQ ID NO: 201 - DNA, 1516 bp, Homo sapiens
gccggctacaggaaattgacttaggcacaggaacttgctaatctcttttgtcacattcggattgctcctgctgccccacacacactaacccaaccatcttggggtggactccctgccagcccaactgttgtattttcagttcttccagtgtgaatcagttaatattctcgggaacgagggagaggttgatcctatgaggaaatcaaccacagtgaaaaggcttgggccgcttttgttttcacctgcttttgttgaacaaatttgatttccggagtcagtcattttactgtcaagacatttcttcggcattctgcaacagtttccaacatggctagatccatcagaaactgaagccgtggagaacgctctcggggcctttgccacttcttggagtagaagccgacagagagctgtttggaaacttctccttcacacaccagttgaagactaggctttggaggttttcaaagcagacggtgcttggatgggcagggagaagtaacattctgcaaatcgccgtcagaggtcctgaggacacagacctacctggcttgcattccccttgctgaatggcgtgtgctgcagctgcccactgagggctcttttccctgggattctggacttcagagtaggacagcaggctgggaagatgctgagttccatcaagtgcgtgttggtgggcgactctgctgtggggaaaacctctctgttggtgcgcttcacctccgagaccttcccggaggcctacaagcccacagtgtacgagaacacaggggtggacgtcttcatggatggcatccagatcagcctgggcctctgggacacagccggcaatgacgccttcagaagcatccggcccctgtcctaccagcaggcagacgtggtgctgatgtgctactctgtggccaaccataactcattcctgaacttgaagaacaagtggattggtgaaattaggagcaacttgccctgtacccctgtgctggtggtggccacccagactgaccagcgggagatggggccccacagggcctcctgcgtcaatgccatggaagggaagaaactggcccaggatgtcagagccaagggctacctggagtgctcagcccttagcaatcggggagtacagcaggtgtttgagtgcgccgtccgaactgccgtcaaccaggccaggagacgaaacagaaggaggctcttctccatcaatgagtgcaagatcttctaaaccccaagagacttcacacaacacttatgtatgcaccccaaagactaatggggagagggagggccgggaagccaggaaagcttggtgttttctctgggtacaccccaagcagcgtctccttttggatacagttattgatgaggcttggccactggatgttttcactaactacactctacaagtgaactccttgcccaggccagttagaaaatcccttggggaactgtgatgaatattccatctttgattaaaaaagtgaaatagtctccataaaaaaaaaaaaaaaaaaaa

SEQ ID NO: 202 - DNA, 1881 bp, Homo sapiens
gcgcttttcactgacaggcgctgttccccacagccagcgccgcccgccacgtcccagctctcggccaacggagctgcgcggcgggtgacctttccgagcccagcgcgatgacggctccttgctcccagccggcgcagcttcctggacgccgccagctcgggctggtgccgttcccgccgccgccgccgcggacgccgctgctgtggctgctgctgctgctgctggccgccgtggcgccggcgcgcggctgggagagcggagacctggagttgtttgacttagtggaggaggtgcagctcaacttctaccagttcctcggggtgcagcaggatgcatcatctgcagacatcagaaaagcatatcgtaagctttcactaactttacatccagacaagaataaagatgaaaatgcagaaactcagtttagacaattggtggccatttatgaagttttaaaggatgatgaacgaaggcagaggtatgatgatattctgatcaatggacttccagattggcgacagcctgtattctactacaggcgggtgagaaaaatgagcaatgctgagctggcattactcttgttcattattctcacagtgggtcattatgctgtggtttggtcaatctacctggaaaaacaactggatgaactactaagtagaaaaaagagagaaaagaaaaaaaagactggcagcaagagtgtggatgtatcaaaactcggtgcttcagaaaaaaatgaaagattgctgatgaaaccacagtggcatgatttgcttccatgcaaactggggatttggttttgccttacactaaaagcattacctcacctcatccaggatgctgggcagttttatgctaaatataaagaaacaagattgaaggaaaaggaagatgcactgactagaactgaacttgaaacacttcaaaaacagaagaaagttaaaaaaccaaaacctgaatttcctgtatacacacctttagaaactacatatattcagtcttatgatcatggaacttccatagaagaaattgaggaacaaatggatgattggttggaaaacaggaaccgaacacagaaaaaacaggcacctgaatggacagaagaggacctcagccaactgacaagaagtatggttaagttcccaggagggactccaggtcgatgggaaaagattgcccacgaattgggtcgatctgtgacagatgtgacaaccaaagccaagcaactgaaggattcagtgacctgctccccaggaatggttagactctccgaactcaaatcgacagttcagaattccaggcccatcaaaacggccaccaccttgcccgatgacatgatcacccagcgagaggacgcagagggggtggcagcggaggaggagcaggagggagactccggtgagcaggagaccggggccactgatgcccggcctcggaggcggaagccagccaggctgctggaggctacagcgaagccggagccagaggagaagtccagagccaagcggcagaaggactttgacatagcagaacaaaacgagtccagcgacgaggagagcctgagaaaagagagagctcggtctgcagaggagccgtggactcaaaatcaacagaaacttctggaactggcgttgcagcagtacccaaggggatcctctgaccgctgggacaaaatagccagatgtgtcccgtccaagagcaaggaagactgtatcgctaggtacaagttgctggttgaactggtccaaaagaaaaaacaagctaaaagctgaatattctgggagatgatgttcaccttcattttccaaaatgaatatcttaaaaatcttatgcagaaatttgcattttgtacctcaatatttctacgtcatgtgccttagt

SEQ ID NO: 203 - DNA, 2916 bp, Homo sapiens
agcggagcccgagcggccgcgaaggcccccgctctccgcttctcccgcccctcgcgacccagaggrctgctggctggctaagtccctcccgctcccggctctcgcctcactaggagcggctctcggtgcagcgggacagggcgaagcggcctgcgcccacggagcgcgcgacactgcccggaagggaccgccacccttgccccctcagctgcccactcgtgatttccagcggcctccgcgcgcgcacgatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaagggtaagcttgatgattaccaggaacgaatgaacaaaggggaaaggcttaatcaagatcagctggatgccgtttctaagtaccaggaagtcacaaataatttggagtttgcaaaagaattacagaggagtttcatggcactaagtcaagatattcagaaaacaataaagaagacagcacgtcgggagcagcttatgagagaagaagctgaacagaaacgtttaaaaactgtacttgagctacagtatgttttggacaaattgggagatgatgaagtgcggactgacctgaaacaaggtttgaatggagtgccaatattgtccgaagaggagttgtcattgttggatgaattctataagctagtagaccctgaacgggacatgagcttgaggttgaatgaacagtatgaacatgcctccattcacctgtgggacctgctggaagggaaggaaaaacctgtatgtggaaccacctataaagttctaaaggaaattgttgagcgtgtttttcagtcaaactactttgacagcacccacaaccaccagaatgggctgtgtgaggaagaagaggcagcctcagcacctgcagttgaagaccaggtacctgaagctgaacctgagccagcagaagagtacactgagcaaagtgaagttgaatcaacagagtatgtaaatagacagttcatggcagaaacacagttcaccagtggtgaaaaggagcaggtagatgagtggacagttgaaacggttgaggtggtaaattcactccagcagcaacctcaggctgcatccccttcagtaccagagccccactctttgactccagtggctcaggcagatccccttgtgagaagacagcgagtacaagaccttatggcacaaatgcagggtccctataatttcatacaggattcaatgctggattttgaaaatcagacacttgatcctgccattgtatctgcacagcctatgaatccaacacaaaacatggacatgccccagctggtttgccctccagttcattctgaatctagacttgctcagcctaatcaagttcctgtacaaccagaagcgacacaggttcctttggtatcatccacaagtgaggggtacacagcatctcaacccttgtaccagccttctcatgctacagagcaacgaccacagaaggaaccaattgatcagattcaggcaacaatctctttaaatacagaccagactacagcatcatcatcccttcctgctgcgtctcagcctcaagtatttcaggctgggacaagcaaacctttacatagcagtggaatcaatgtaaatgcagctccattccaatccatgcaaacggtgttcaatatgaatgccccagttcctcctgttaatgaaccagaaactttaaaacagcaaaatcagtaccaggccagttataaccagagcttttctagtcagcctcaccaagtagaacaaacagagcttcagcaagaacagcttcaaacagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggaggatatgatggttaccgcccttcattctctaacactccaaacagtggttatacacagtctcagttcagtgctccccgggattactctggctatcaacgggatggatatcagcagaatttcaagcgaggctctgggcagagtggaccacggggagccccacgaggtaatattttgtggtggtgatcctagctcctaagtggagcttctgttctggccttggaagagctgttaatagtctgcatgttaggaatacatttatcctttcaagacttgttgctagggattaaatgaaatgctctgtttctaaaacttaatcttggacccaaattttaatttttgaatgatttaattttccctgttactatataaactgtcttgaaaactagaacatattctcttctcagaaaaagtgtttttccaactgaaaattatttttcaggtcctaaaacctgctaaatgtttttaggaagtacttactgaaacatttttgtaagacattttggaatgagattgaacatttatattaatttattattcctctttcatttttttgaaacatgcctattatattttagggccaggaaccctttaatgggcggataagccatagttaacatttagagaaccatttagaaagtgatagaactaatggggatttgggaagggctttggcacctctattagtgattaaatatctcagttatttctggacttttaaacaaaaattccaaattccaacttattggagtatacttaaaaaaatttg

SEQ ID NO: 204 - DNA, 599 bp, Homo sapiens
aggccgcgctcgcgccgaggggctgcgagagtgaccgcggctgctccagcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaaatccttaaaaaagtaagccaacaaacagaaaagacaacaacagtgaaattcaacagaagaaaagtaatggactctgatgaagatgacgattattgaactacaagtgctcacagactagaacttaacggaacaagtctaggacagaagttaagatctgattatttactttgtttattgtctatatgccttttaaaaaaataaacttgttatgcaaaataaaaaaaaaaaaaaaaaaaaaaaaaaaaaaaaaaaa

SEQ ID NO: 205 - DNA, 1407 bp, Homo sapiens
ctctccccggcccgatccgcccgccggctccccctcccccgatccctcgggtcccgggatgggggggcggtgaggcaggcacagccccccgcccccatggccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggcgagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgaggggccctggtctccccgcagtcgtcccaggctgccggctcccctcgacagctctctgggcacccggtcccctctgccccaccctcagccgctctttgctccagacctgcccctccctctagaggctgcctgggcctgttcacgtgttttccatcccacataaatacagtattcccactcttatcttacaactcccccaccgcccactctccacctcactagctccccaatccctgaccctttgaggcccccagtgatctcgactcccccctggccacagacccccagggcattgtgttcactgtactctgtgggcaaggatgggtccagaagaccccacttcaggcactaagaggggctggacctggcggcaggaagccaaagagactgggcctaggccaggagttcccaaatgtgaggggcgagaaacaagacaagctcctcccttgagaattccctgtggatttttaaaacagatattatttttattattattgtgacaaaatgttgataaatggatattaaatagaataagtcataaaaaaaaaaaaaaaaaaaaaa

SEQ ID NO: 206 - DNA, 3340 bp, Homo sapiens
ctctaaagctttagagcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaggcggagacgtctacgtggagagggtccagggcaactcagtcttgttgcacatctcaaaactccagatgaaggatgctggcgagtatgagtgtcacacaccaaacactgatgagaattactatggaagttacagagcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccagctttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcgtgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaggtgatgttaaccaacacctttgacctgtcctgtgtcgtgagggccggttactctgacctcaaggtgccactcactgtgacgtggcagttccagccagctagctctcacatattccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagggcaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcacg

SEQ ID NO: 207 - DNA, 1677 bp, Homo sapiens
atgtatttcttcctcaattacctctcactctccgacctttgctacacatccacagtgacccccaaattaatggttgacttactggcagaaagaaagaccatttcctataataactgtatgatacaactctttaccacccatttttttggaggcatagagatcttcattctcacagggatggcctatgaccgctatgtggccatttgcaagcccctgcactacaccattattatgagcaggcaaaagtgtaacacaatcatcatagtttgttgtactgggggatttatacattctgccagtcagtttcttctcaccatctttgtaccattttgtggcccaaatgagatagatcactacttctgtgatgtgtatcctttgctgaaattggcctgttctaatatacacatgataggtctcttagtcattgctaattcaggcttaattgctttggtgacatttgttgtcttgttgttgtcttatgtttttatattgtataccatcagagcatactctgcagagagacgcagcaaagctcttgccacttgtagttctcatgtaattgttgtggtcctgttttttgcacctgcattgttcatttacattagaccggtcacaacattctcagaagataaagtgtttgcccttttttataccatcattgctcccatgttcaaccctctcatatacacgctgagaaacacagagatgaagaacgccatgaggaaaaacttgacccattccatggaaaaaataaacaacgtaactgaattcattttctggggtctttctcagagcccagagattgagaaagtttgttttgtggtgttttctttcttctacataatcattcttctgggaaatctcctcatcatgctgacagtttgcctgagcaacctgtttaagtcacccatgtatttctttctcagcttcttgtcttttgtggacatttgttactcttcagtcacagctcccaagatgattgttgacctgttagcaaaggacaaaaccatctcctatgtggggtgcatgttgcaactgtttggagtacatttctttggttgcactgagatcttcatccttactgtaatggcctatgatcgttatgtggctatctgtaaacccctacattatatgaccatcatgaaccgggagacatgcaataaaatgttattagggacgtgggtaggtgggttcttacactccattatccaagtggctctggtagtccaactacccttttgtggacccaatgagatagatcactacttttgtgatgttcaccctgtgttgaaacttgcctgcacagaaacatacattgttggtgttgttgtgacagccaacagtggtaccattgctctggggagttttgttatcttgctaatctcctacagcatcatcctagtttccctgagaaagcagtcagcagaaggcaggcgcaaagccctctccacctgtggctcccacattgccatggtcgttatctttttcggcccctgtacttttatgtacatgcgccctgatacgaccttttcagaggataagatggtggctgtattttacaccattatcactcccatgttaaatcctctgatttatacactgagaaatgcagaagtaaagaatgcaatgaagaaactgtggggcagaaatgttttcttggaggctaaagggaaatag

SEQ ID NO: 208 - DNA, 1353 bp, Homo sapiens
caggctattccggacgccagccctggaagctgagcctgacccagcaggtcccagcagcctggcagcccggccagcatgcagcagcagcctctgcccgggcctggcgcccccacaactgagccaaccaagcctccctacagctacatcgcccttattgctatggccatccagagctcaccggggcagcgggccaccctcagtggcatctaccgctacatcatgggccgattcgccttctaccgccacaaccggcccggctggcagaacagcatccgccacaacctgtcactcaacgagtgctttgtcaaggtgccccgcgatgaccgcaagccaggcaagggcagctactggacgctggaccctgactgccacgacatgtttgagcacggcagcttcctacgccgccgccgccgcttcacccggcagacaggtgctgagggcacccggggccccgccaaggcacgccgtggacccctcagggcgaccagccaggacccaggagtccccaacgccacgaccggcaggcagtgctcattcccaccagagctgccagatcccaagggcctaagctttgggggtctggtgggggccatgccagccagtatgtgcccagcaaccactgatggcaggcctcggccacccatggagcccaaagagatttccacgcccaagcctgcatgcccaggggagctccccgtggccacctcatcttcctcatgcccagcgtttggctttcctgccggcttctcagaggctgagagttttaataaggcccctacgcccgtcttgtccccggaatcaggcatcgggagcagctaccagtgtcggctgcaggcactgaatttttgcatgggggctgacccaggccttgagcacctcttggcctcagcagccccctcccctgcaccacccacccctccaggctcactccgggccccactgcccctgccaactgaccacaaggaaccctgggttgcaggtggcttccctgtccagggaggctccggctacccattggggctgaccccctgcctataccggacgccaggaatgttcttctttgagtaaaggcagcctcacctcgggcagtccctgcaggtccctcaccctccgggctgagcctggctctaggacctgaagaactctcgaaggacccagccctggtgagccaaggacaaccacacagaaagccaggattgaagcggtgctcagccaggcccctggggcctccggacaaacttgggggtgaggggaagcagggcctcttgggatttactctgtggctctcagggccaataaagccatgtgatgatgagggaaaaaaaaaaaaaaaaaaaaaaaaaaaaaaaaaaa

SEQ ID NO: 209 - DNA, 1506 bp, Homo sapiens
atgcaggcgcgctactccgtgtccgaccccaacgccctgggagtggtgccctacctgagcgagcagaattactaccgggctgcgggcagctacggcggcatggccagccccatgggcgtctattccggccacccggagcagtacagcgcggggatgggccgctcctacgcgccctaccaccaccaccagcccgcggcgcctaaggacctggtgaagccgccctacagctacatcgcgctcatcaccatggccatccagaacgcgcccgagaagaagatcaccttgaacggcatctaccagttcatcatggaccgcttccccttctaccgggagaacaagcagggctggcagaacagcatccgccacaacctctcgctcaacgagtgcttcgtcaaggtgccccgcgacgacaagaagcccggcaagggcagttactggaccctggacccggactcctacaacatgttcgagaacggcagcttcctgcggcgccggcggcgcttcaaaaagaaggacgtgtccaaggagaaggaggagcgggcccacctcaaggagccgcccccggcggcgtccaagggcgccccggccaccccccacctagcggacgcccccaaggaggccgagaagaaggtggtgatcaagagcgaggcggcgtccccggcgctgccggtcatcaccaaggtggagacgctgagccccgagagcgcgctgcagggcagcccgcgcagcgcggcctccacgcccgccggctcccccgacggttcgctgccggagcaccacgccgcggcgcccaacgggctgcctggcttcagcgtggagaacatcatgaccctgcgaacgtcgccgccgggcggagagctgagcccgggggccggacgcgcgggcctggtggtgccgccgctggcgctgccatacgccgccgcgccgcccgccgcctacggccagccgtgcgctcagggcctggaggccggggccgccgggggctaccagtgcagcatgcgagcgatgagcctgtacaccggggccgagcggccggcgcacatgtgcgtcccgcccgccctggacgaggccctctcggaccacccgagcggccccacgtcgcccctgagcgctctcaacctcgccgccggccaggagggcgcgctcgccgccacgggccaccaccaccagcaccacggccaccaccacccgcaggcgccgccgcccccgccggctccccagccccagccgacgccgcagcccggggccgccgcggcgcaggcggcctcctggtatctcaaccacagcggggacctgaaccacctccccggccacacgttcgcggcccagcagcaaactttccccaacgtgcgggagatgttcaactcccaccggctggggattgagaactcgaccctcggggagtcccaggtgagtggcaatgccagctgccagctgccctacagatccacgccgcctctctatcgccacgcagccccctactcctacgactgcacgaaatactga

SEQ ID NO: 210 - DNA, 4268 bp, Homo sapiens
agcccggcagagacagggcactggtttccctctaccagagttcctgacccagccgagaacaaaccgcgaagcaagttcagccgaacaacgatggtgaaaagggtcctcctgctcacagtgtgaataacaggatatcctcagaccatctcaaaaaggaggaaaagatgactatgatggctcaccagtacccctcttggatcttcattaatgagaagacattcataaccagggaacaacttaattctttattgaagacctataacattttttatgagaaccagaaaaatctgcatattttatatggagagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagactatttatcttatcacagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaacatcaattttcattccagcctttgaatcagaaactaaggtcagagtaaacagtaacatgagaactgaagaagtaataaagcaacttctccaaaaatttaagattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaatgtcttcaaaataaactagtaataaaaacagagacaacagtttagcagtacaagcttctattgctaaaacatttcaaaaaactcagagatattactctttgatgaatgcataagttctgtacttgcatttatacgaacatatatgagacttgaatcgtagaaaattgaatgtcaaaaaaagctcatttctttttgaagtgatgaggttaattagggttcacagttggacaaaatgagtttgagtttagtttcagtaactgaaataagcttgaatactgcatatgccaaatagcttttatagtaaaccatgtaatgaactcaaatttaaatggtgtcttcagataagcagtttaaacttcatttagcttggactctcaagagaactgaaacataatcaatggattcagaaatgactcagaaaaaagaagctgccagttcttggaatgaaaaagaaatacagtcttacaccatcaaggaatctacctgatagtgacagtagcttcttgaaaactctggcattttcataaaatctaggactatcttaaatggcctgttgacttctgactatctgtaacatcagagctgtctggcctttggaaaggaaaaattatggactctgttaagaaatcctaattgaaattttctgaacctccccccagcccttttattctctctcttctgctgatgaaagacctttcatcagttcaaagcttttcttaagctcttttttaagttaattgaactttttctttatttatttttcaaaaaaatgtttatatcacatagacatattacatcggctaaagcaagacttggcccacaaatacctatttgttgctgaatgaatacaatggataaagcaaggctgttgtagctgaagttacatagggaatcccaaactctgccctcttagcatcttattctacatgacaactctcaaggtactcacagatctgtttaacccacttgaaaaaaaaacactaaaaatgaagaaatgctataagtataaactatgattttatttataaattctgtattaaaatggaattatatgcaacattctttcattctgtaaactaattccatttgcattcctcataagcattgtagtaaattgatcatattacatgtactaaggaatgagattatatgcagtaaacccaactggaagattaacaatattaaaatatgaaacatttttaagacaaaggcattacttctcagtattaccaaacctaaactggttgaaggtgaaagtgtgctatggccttttcaagcctaagaagtctctcttactgagtaaaccagaggcttgcatcgctattctttcacctgtcaatattaataagaaaatagtctcatctcacttaaatgaggcaaatgtaatagttaaaattcaacatacttataaaaaactagtgtcatgtacctgccatgaacatgacaaaaggttagtcttcaatagactgaaatgtataagagaagaaccaagtcttacatagaaaaaaaaggtagatatgaaaagaaaaatcacagaagagagaatgcaaatggccactaagtatatgaaaaaagtcgtatcttaacagtgaacaactgtgttagtctgtatcaatcagaagacagaaacaaggtagtaatttaaacagggaaagtttaatataaataataattaagctatgataggagaataataataaagatgaaaagagaaggtaccctaaggctgagggaaagaatcctaacaaggaaaggcaggaatgagggtttcagaattcactggagaaggtgtggttgcagcccactggagagaagtttgctggcttgcccaggccagagcaggaccacagatactggacaagctggtacagccaaccccctaggtgtggaccagctgaggcaggtgggcagatatgcagagggacttggggctttgccaaagggtaagcacaaagaaggagtcacgggttctgttcgaggcactgttgggattaggagtcggagggacctactttgcaggaacctagcataactttgtgtgacgagactgcacaagacaaagctcaggcaagtggctcagtagttggccagcccagcagggtcctctgtatgagtgtgcacccagctgaagagaagaaatggagagcagcaattggagcttcaggaccggcttgcactgtggctccaggttataccaccactgcccaaagcaaaagctagagaagcaagtggagaaatgctggagaaagctgcaccctacaggcaaccagcactgcagaaaccactccaggcaaagtagtgaaggaaaaaagcctgctctccagtagcctggcctgtcagcctggaggaatcaggaaagaccccttcctcttgcagtgtgtctccagcgccctctactgacaaagtatgccatcatgcaagctgcaaaggaaacatttcaagagtctatatctattttcacggagcgggcaaccaacagtgaatgtggagctgagagacagtaaaataataactgacatgccaccgaagtacaaagtaaaataaataaataaatacacattttggcctattagcaaagattaagaaatgataacattaaatactcaataaatcaccatgagatggggactcaaacttctggtaaaaatacaaatagatataatttttcttgaaggcaatttagtagtctgtttatcctataattctacttgtaagatcctatcatatgaaaataaccagagatacaaagacattctgcaaagatatgttttatattgttatttattgtgacaaaaggaaataaaaagcctaaatgttcagaaaattattttaaaagatgaaagagggaaataggccatggacggtggctcacgcctgtaatcccagcactttaggaggccaaggtaggtggatcacttgaggttgggatttcgagaccagcctggccaacatggtgaaaccctgcctctactaaaaatacaaaaaatgagccgggtgcaatggcaggcgcctataatgccagctactcgggaggctgaggcaggagaatcgcttgaacccgggaggcggaggttgcatgagccgagatggcgccactgctctccagcctggacgacagagcaagactccgtctct

SEQ ID NO: 211 - DNA, 3132 bp, Homo sapiens
cggatcgcagctctcgcggcagtcgcctgagacttaaggttattgcttggccgcggcctggtattccggcgattcgtttcttgctcggcttcctggagctgtggtccgtgtgggcttccacctcagacagttgcgctggctcagcggggccggaacatggctgcgtccggtctggatcatctcaaaaatggctacagaagaagattttgtcgaccttccagggcacgtgacattaacacagagcaaggccagaatgttctggaaatcttacaagactgttttgaagaaaaaagtcttgccaatgattttagtacaaattctacaaaatcagtgcctaattcaacacgcaaaataaaagacacttgtattcagtcaccaagcaaagagtgccagaaatcacatccaaagtcagttccagtttcttcaaagaagaaagaagcctctctacagtttgttgtagaaccaagtgaagccacaaacagatcagttcaggcccatgaagttcatcagaaaattctggcaactgatgttagttccaaaaatacacctgactcgaaaaaaatatcaagtagaaacataaatgatcatcacagtgaagctgatgaagaattttacttatccgttggctcaccttctgttcttttggatgcaaaaacatctgtatcacaaaatgttattccatctagtgccaaaaagagagagacttacacttttgaaaattcagtaaatatgctgccttcaagtacagaggtttcagttaaaaccaaaaaaaggttaaactttgatgataaagttatgttaaagaaaatagaaatagataataaagtatcagatgaagaggataaaacatcggaaggacaagaaagaaaaccatcaggatcatctcagaatagaatacgagattcagaatatgaaattcaacgacaagctaaaaaaagtttttcaacattgtttttagaaacagtaaaacgaaaaagtgaatccagtcccattgttaggcatgcggcaactgctccacctcattcgtgtcctcccgatgatacgaagttgatagaggatgaatttataattgatgagtcggatcaaagttttgccagtagatcttggattacaataccaagaaaggcagggtctctgaaacaacgcacaatatccccggctgagagcactgcactctttcaaggtagaaagtcaagagaaaagcatcataatatattacctaagactttggcaaatgacaaacattcccataaacctcacccagtagagacatctcagccctctgataaaacagtactggatacaagttatgctttgatagatgaaacagtaaataattatagatctacaaaatatgaaatgtattccaagaatgcagaaaaaccatctagaagcaaaaggactataaaacaaaaacagagaagaaaattcatggctaaaccagctgaagaacagcttgatgtgggacagtctaaagatgaaaacatacatacatcacatattacccaagacgaatttcaaagaaattcagacagaaatatggaagagcatgaagagatgggaaatgattgtgtttccaaaaaacagatgccacctgtgggaagcaagaaaagtagcactagaaaagataaggaagaatctaaaaagaagcgcttttccagtgagtccaagaacaaacttgtacctgaagaagtgacttcaactgtcacgaaaagtcgaagaatttccaggcgtccatctgattggtgggtggtaaaatcagaggagagtcctgtttatagcaattcttcagtaagaaatgaattaccaatgcatcacaatagtagccgaaaatctactaagaaaacaaatcagtcatctaagaatattaggaaaaaaactattccacttaaaaggcagaagacagcaactaaaggcaaccaaagagtacagaagtttttaaatgctgaaggttctggaggtatcgttggtcatgatgaaatttccagatgttcactgagtgagccattggaaagtgatgaggcagacttggctaagaagaaaaatcttgattgttctagatctacaagaagctcaaagaatgaagataacattatgactgcacagaatgttcccctaaagcctcagaccagtggatatacatgtaatataccaacagagtcaaacttggattctggagagcataagacttcagttttagaggaaagtggaccttccaggctcaataataattatttaatgtctggaaagaatgatgtggatgatgaggaagttcatggaagttcagatgactcaaaacaatctaaagtgataccaaagaacagaatccatcacaaactagtattgccctccaacacaccaaatgttcgcaggaccaagagaacacgtttgaaacctttggagtactggcgaggagagcgaatagattatcaaggaaggccatcaggaggattcgtgattagtggagtactatctccagacacaatatcgtctaaaaggaaggcaaaagaaaatattggaaaagtcaacaaaaaatctaataagaaaaggatctgtcttgataacgatgaaagaaagactaacttaatggtaaatctaggtatacctcttggagatcctttgcagccaacgagggtaaaggacccagaaacaagagagattattctcatggatcttgtaaggccacaagatacatatcaattttttgttaagcatggtgagttgaaggtatacaagacattggatacaccctttttttctactgggaaattgatattaggaccacaagaagaaaagggaaagcagcatgttggccaggatatattggttttttatgttaactttggtgaccttttgtgtactttacatgaaacaccttatatattaagtactggggattcgttctatgttccttcaggtaactattataacatcaaaaatctccggaatgaggaaagtgttcttctttttactcagataaaaagatgaaagatcaaccaaccttaaatatatgtatgtatatatgtatatgtaaaaacagtttgtatagttggaatatttgtctttgtaattacttgtgatgttttaaaataaaaattttattcagttttgtgtaaaaaaaaaaaaaaaaaa

SEQ ID NO: 212 - DNA, 5024 bp, Homo sapiens
gggacacttgacatcagtggtgtcaagacaactctaagaaggttttccatgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcacggcctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagggctgaatggtcgctgagacagagatggaagccaggacaagggagcccaccgggcccagatagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatatttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccaaaaaaaaaa

SEQ ID NO: 213 - DNA, 5371 bp, Homo sapiens
gggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagctttatcagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtttatatgccagaaattctgtaccattttgtatcagggaattgagcatcttcagatgttggtatctgcagggatcctggaaccaaacccctgcagatactaagggctgacgatctaggtaagactggatttaacagttggaaa

SEQ ID NO: 214 - DNA, 1763 bp, Homo sapiens
atcaagcaggggcagggctggcgctgcggcgggagatgctgtcgggccgcggcggcgcttggcagccaggagctctgcattgaaggcactggggtaaagtgaatgccgaagacagaagatttggatgatacaccactgactttctttgtttggaatacacgttatgaaccctttctggagcatgtctacaagctctgtacgcaaacgatctgaaggtgaagagaagacattaacaggggacgtgaaaaccagtcctccacgaactgcaccaaagaaacagctgccttctattcccaaaaatgctttgcccataactaagcctacatctcctgccccagcagcacagtcaacaaatggcacgcatgcgtcctatggacccttctacctggaatactctcttcttgcagaatttaccttggttgtgaagcagaagctaccaggcgtctatgtgcagccatcttatcgctctgcattaatgtggtttggagtaatattcatacggcatggactttaccaagatggcgtatttaagtttacagtttacatccctgataactatccagatggtgactgtccacgcttggtgttcgatattcctgtctttcacccgctagttgatcccacctcaggtgagctggatgtgaagagagcatttgcaaaatggaggcggaaccataatcatatttggcaggtattaatgtatgcaaggagagttttctacaagattgatacagcaagccccctgaacccagaggctgcagtactgtatgaaaaagatattcagctttttaaaagtaaagttgttgacagtgttaaggtgtgcactgctcgtttgtttgaccaacctaaaatagaagacccctatgcaattagcttttctccatggaatccttctgtacatgatgaagccagagaaaagatgctgactcagaaaaagcctgaagaacagcacaataaaagtgttcatgttgctggcctgtcatgggtaaagcctggctcagtacagcctttcagtaaagaagagaaaacagtggcgacttaagagatggtgaatctggtgcaccatgcactttcctgctagactctggcctagttcaagctgaccaatggcagaggactgcctgaagagtaaaactgtgtgaacaatgactgactgccagtgttttccatgtatgcataggttctaacagcagggtttggaaacctgtctctaagtaatgcattacttctgtcagaagtgtcttagggtggttatctagttcagtactccaaattattggggaccttgaggcttaagtaagtatttttctgaatataatgctaaaggtaagttgcattcatttaaactaatagagcagacagaattcagcactacttaatagtttataaatcagtggtttcagttgtatatatgttaggaaatggagaggtatagagagagcaggttccatagctcagcacttttaagtggaagatcatttgaatctcagtcttcagcctgcactgatttgtagcctgcactgtcttactgatttacaaactgaaatcactgagaaatgtctttagttcagtgagaagaaaccagaacacttgttcctagtgttgtgttgttttttttaagcaaattacttactgtatttttatggcaggagggagaaaaagtgttacaacggcttctaatgaagtccggtatttaaatgataaatgactaatgtgtttagtagagacaaaataaaccaataaatgattgttctttgccattt

SEQ ID NO: 215 - DNA, 3338 bp, Homo sapiens
cccagcccggccccgccgccccggctgcgcacgcgacgccccctccaggccccgctcctgcgccctatttggtcattcggggggcaagcggcgggaggggaaacgtgcgcggccgaaggggaagcggagccggcgccggctgcgcagaggagccgctctcgccgccgccacctcggctgggagcccacgaggctgccgcatcctgccctcggaacaatgggactcggcgcgcgaggtgcttgggccgcgctgctcctggggacgctgcaggtgctagcgctgctgggggccgcccatgaaagcgcagccatggcggagactctccaacatgtgccttctgaccatacaaatgaaacttccaacagtactgtgaaaccaccaacttcagttgcctcagactccagtaatacaacggtcaccaccatgaaacctacagcggcatctaatacaacaacaccagggatggtctcaacaaatatgacttctaccaccttaaagtctacacccaaaacaacaagtgtttcacagaacacatctcagatatcaacatccacaatgaccgtaacccacaatagttcagtgacatctgctgcttcatcagtaacaatcacaacaactatgcattctgaagcaaagaaaggatcaaaatttgatactgggagctttgttggtggtattgtattaacgctgggagttttatctattctttacattggatgcaaaatgtattactcaagaagaggcattcggtatcgaaccatagatgaacatgatgccatcatttaaggaaatccatggaccaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcaamaaaaaaaaagttaaactcttcttttctttttattataatgaccagcttttggtatttcattgttaccaagttctatttttagataaaattgttctccttctaaaaaaaaaaaaaaaaaaaaaaa

SEQ ID NO: 216 - DNA, 1834 bp, Homo sapiens
ctcttccctgcaaaccatgtttgccaaaggcaaaggctcggcggtgccctcggatgggcaggctcgggaaaagttagctttatacgtctacgaatatttactgcacgtaggagcacagaaatctgcacagactttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtgatccccccttctccgagacgctgagagagcaggcattgcaggcgggaagatgccagaaattatgcaagaagtgaggtgtcattatccaggagctggtggggagggcatctccctgctcccctcaaccccctcccaccccatccacgccccctacctttcccaattttagtttcatgcaataaaaaggccaaactttttattccataaaacaagaaggacaaaactctcaaaaatgtatttcaagtcagtgaccagaaaaatcccaccccttgccctttccccaaaggaccttttctgtacatgacacttttttgttgttttttgtttggggttttaccattgttgggatttttttatttgttttcaggggggttttttgggggaaaatttttttaaatggaagcttctagcaagccccccaccccaatcaacctctatgctttcttcttaaaaaaaaaaaaaaaggaaaaaggaaaaaaaaaaaaggaaaaccagaagccctgctgtctgtctgtgcccaagcccttccaccagaaaagctagtctaggtgtgagagcccacattgtctgtagccatcaaaaataataataataaactggacagtttacaatcgttggtttctttcaaaaggccttttttggaaagaagaaa

SEQ ID NO: 217 - DNA, 2324 bp, Homo sapiens
cattttgtgggtggggcttcaggtgccacccagctgaaggatggccacccctgtggtcaccaagacagcctggaagttgcaagagatcgtcgcgcatgccagcaacgtgtcctcactggtgctgggcaaagcctccgggcggctgctggctacaggcggggatgactgccgcgtcaacctgtggtccatcaacaagcccaactgcatcatgagcctgacgggccacacatccccagtggagagcgtccgcctcaacacccccgaggagctcatcgtggccggctctcagtcgggctccatccgtgtctgggacctggaagctgccaaaattcttcgcacactcatgggactcaaagccaacatctgcagcctggatttccacccgtacggcgagtttgtagcctctggttcccaggacacaaacatcaagctctgggacatcaggaggaaaggctgtgtcttccgatacagggggcacagccaggccgtgcggtgtctccggttcagccccgatgggaagtggttggcgtcggccgcagatgaccacaccgtgaagctctgggatctcactgccggcaagatgatgtctgagttccctggtcacacggggcctgtcaacgtggtcgagtttcaccccaacgagtacctcctggcctccggcagctctgacgggacaatccgcttctgggacctggagaagttccaggtggtgagccgcatcgaaggggagcctgggcccgtcaggagcgtcctcttcaacccagacggctgctgcctgtacagcggctgccaggactcactgcgtgtctacggctgggaacctgagcggtgctttgatgtggtcctcgtcaactggggcaaggtggccgacctggccatctgcaatgaccagttgataggtgtggccttctcccagagcaacgtctcctcctacgtggtggatctgacgcgtgtcaccaggactggcacggtggcccgggaccctgtgcaggaccaccggcccctggcacagccactgcccaaccccagcgcccccctccggcgcatctatgagcggcccagcacaacctgcagcaagcctcagagggtgaagcagaactcagagagcgagcgccgcagccccagcagcgaggatgaccgggacgagcgcgagtcccgcgcggagatccagaacgccgaggactacaacgagatcttccagcccaagaacagcatcagtcggacgccaccccggagaagtgagcccttccctgcacccccagaggacgacgcagccacagcaaaggaggcagcaaagcccagccctgccatggatgtgcagttcccggtgccaaatctggaggtcctgccccggcccccagtggttgcttccacacctgcacccaaggctgagcctgccatcatccctgccacccggaacgagcccatcgggctgaaggcctccgacttcctgcccgccgtgaagatcccccagcaggccgagctggtggacgaggatgccatgtcacagatccgcaaaggccacgacaccatgtgtgtggtgctcaccagccgccacaagaacctggacactgtgcgggctgtgtggaccatgggcgacatcaagacgtcggtggactccgctgtggccatcaacgacctgtcggtggtggtggacctcctgaacatcgtcaaccagaaagcctccctgtggaagctggacctgtgcaccaccgtcctgccacagattgagaagcttctgcagagcaagtatgagagctacgtccagacgggctgcacctccctgaagctgatcctgcagcggtttctgcccctcatcacagacatgctggcggccccaccctctgtgggtgtggatatcagcagggaggagaggctgcataagtgccggctctgctacaagcagcttaagagcatcagcggcctggtcaagagcaagtcaggcctgagcggccgccatggcagtaccttccgcgagctgcacctgctcatggccagtctggactgaggaaagcagtgggcaggggcgctcggcagcccacagggcctggcctcagcccccactcctgttccttgtgcacccactggcccatgagcctctgcctggcccctgctgctgtcctgtggccgtcctggaggaggtgatgctggtccctggccacctctacagccctgaactcttgagacaactctctccagcaatagctgcccagctttgcccaactgttgcttcttggggcagcgaactgagccctggggctgctgctgtaatttataaggcaaattttattaaatttgtaactattaaaaaaaaaaaaaaaaaa

SEQ ID NO: 218 - DNA, 966 bp, Homo sapiens
atgtctggggacaacagctccagcctgaccccaggattctttatcttgaatggcgttcctgggctggaagccacacacatctggatctccctgccattctgctttatgtacatcattgctgtcgtggggaactgtgggctcatctgcctcatcagccatgaggaggccctgcaccggcccatgtactacttcctggccctgctctccttcactgatgtcaccttgtgcaccaccatggtacctaatatgctgtgcatattctggttcaacctcaaggagattgactttaacgcctgcctggcccagatgttttttgtccatatgctgacagggatggagtctggggtgctcatgctcatggccctggaccgctatgtggccatctgctaccccttacgctatgccaccatccttaccaaccctgtcatcgccaaggctggtcttgccaccttcttgaggaatgtgatgctcatcatcccattcactctcctcaccaagcgcctgccctattgccgggggaacttcatcccccacacctactgtgaccatatgtctgtggccaaggtatcctgtggcaatttcaaggtcaatgctatttatggtctgatggttgctctcctgattggtgtgtttgatatctgctgtatctctgtatcttacactatgattttgcaggctgttatgagcctgtcatcagcagatgctcgtcacaaagccttcagcacctgcacatctcacatgtgttccattgtgatcacctatgttgctgcttttttcacttttttcactcatcgttttgtaggacacaatatcccaaaccacatacacatcatcgtggccaacctttatctgctactgcctcctaccatgaacccaattgtttatggagtcaagaccaagcagattcaggaaggtgtaattaaatttttacttggagacaaggttagttttacctatgacaaatga

SEQ ID NO: 219 - DNA, 4853 bp, Homo sapiens
ttcgccgtttgaattgctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgtctgccgagtcgcccacccctcagatccagcagcggttcgacgagctgtgcagccgcctcaacatggacgaggcggcgcggcccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcattccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccactcagtgattactgtcaaggctgcttacaatccaaacttgggtttttggctctggcaaagcttttagaaatactgcaagaaatgatgtgtacccaacgtgagcataggaggcttctgttgacgtctccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaagtcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctccccaaatatttataaaacttctcaagatactgctacgtgtaattttatatgaagataagtgtatttttcaataaagcatttataaattaaaaaaaaaaaaaaaaaa

SEQ ID NO: 220 - DNA, 2062 bp, Homo sapiens
cctgggtcccgtcacatccttcttgctcaaccactgggtgcacaggatggaaacttctattccctctctggaagacagcgcgtggcttggcttcacagagttgtggctggagaccgaagcagcccctttctcaggcttactgtcaccagtctgtctgtgttaggggagaggggagtccgctctgtcctgaaggcccagagatggaaggacaagtggtaggccgggtgttcaggctcttccaacgccgactgcttcaactccgagcaggaccaccccaggacaattcaggggaagctttaaaggaaccagaaagggcccaggagcactctttgcccaactttgctggggggcagcacttctttgaataccttcttgtggtttctctcaaaaagaagcgttcagaggatgattacgagcctataatcacctaccaatttcccaagcgggagaacctgcttcggggtcagcaggaggaggaggagcggctgctcaaagctatccccttgttctgcttcccagatgggaatgagtgggcatcactcaccgagtatcccagggagaccttctccttcgttctgaccaatgtggatgggagcagaaagattggatactgcaggcgcctcttgcctgccggccctggccctcgccttcccaaagtgtactgcatcatcagctgcatcggctgcttcggcttgttctccaagatcctggatgaagtggagaagagacatcagatctccatggctgtcatctacccgttcatgcagggcctccgagaggcagccttccctgctcctgggaagactgtcactctcaagagcttcatccccgactcaggcactgagttcatttcactgacacggcccctggactcccacctagaacatgtggattttagttctctattgcactgtctcagttttgaacagatacttcagatctttgcctctgccgtgctggagagaaaaatcatcttcctggcggaaggtctcagcaccttgtctcagtgcatccatgctgctgccgcactgctctaccccttcagctgggcgcacacctacatccctgttgtccctgagagccttctggccaccgtctgctgccccacccccttcatggttggagtacaaatgcgcttccagcaggaggtcatggacagccctatggaagaggtcctgctggtcaatctttgtgaaggaaccttcttaatgtcggttggtgatgaaaaagacatcctgccaccgaagcttcaggatgacatcttagactctcttggtcaggggatcaatgagttaaagactgcagaacaaatcaacgagcatgtttcaggcccctttgtgcagttctttgtcaagattgtgggccattatgcttcctatatcaagcgggaggcaaatgggcaaggccacttccaagaaagatccttctgtaaggctctgacctccaagaccaaccgccgatttgtgaagaagtttgtgaagacacagctcttctcacttttcatccaggaagccgagaagagcaagaatcctcctgcaggctatttccaacagaaaatacttgaatatgaggaacagaagaaacagaagaaaccaagggaaaaaactgtgaaataagagctgtggtgaataagaatgactagagctacacaccatttctggacttcagcccctgccagtgtggcaggatcagcaaaactgtcagctcccaaaatccatatcctcactctgagtcttggtatccaggtattgcttcaaactggtgtctgagatttggatccctggtattgatttctcaggactttggagggctctgacaccatgctcacagaactgggctcagagctccattttttgcagaggtgacacaggtaggaaacagtagtacatgtgttgtagacacttggttagaagctgctgcaactgccctctcccatcattataacatcttcaacacagaacacactttgtggtcgaaaggctcagcctctctacatgaagtctgtggacatgtaaggacgagagtaaagaggaaaatcttataaaaaaaaaaaaaaaaaaaa

SEQ ID NO: 221 - DNA, 2268 bp, Homo sapiens
  modified_base (13)..(13): a, c, g, t, unknown or other
gggatttgaaccncgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaatatcttgtaaatattcctgtattctcaacttttttccttttgtaaatttttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcaaaaaaaaaaaaaaa

SEQ ID NO: 222 - DNA, 874 bp, Homo sapiens
ggggtacgcgggcaagatggaggcgactacggctggtgtgggccggctagaggaagaggcgttgcggcgaaaggaacggctgaaggccctacgggagaaaaccgggcgcaaggacaaggaagatggggagccaaagaccaagcatctcagagaagaggaggaagaaggcgagaagcacagggaacttaggctgcggaactatgtcccggaggatgaggacctgaagaagaggagggtgccccaggccaaaccggttgcagtggaggagaaggtgaaggagcagctggaggccgccaagcccgagcccgtcatcgaggaggtggacctggccaacctcgctcctcggaagcctgactgggacctcaagagagatgtggccaagaagctggagaaactaaaaaagcggactcagagggctattgccgagctgatccgtgaaaggctgaaaggccaggaagacagcctagcctctgcagtggatgctgccaccgaacaaaagacctgtgactccgactgaggcatgccctgccccaccactcgcccatcaggcctgtcctgcaggggatggtcttgggcagggatgggggctaggcttgccatcacctccagtttggcttctgagcagagactccctgcccatcaagtctgaaacccccatggatgaggtcagctccttgtctgctgggtggcccctgccattctgaatggaggcagaaccagcaacaactctgggcgtgcctgtgtctgcacatgtggatgtacatatgtctgtatatatgtatatattttgaactttctaaaaaaaaatctggaaatagaaacaagtaaacccctgtgtgtggcgaaaaaaaaaaaaaaaaaaaaaaaaaaaaaa

SEQ ID NO: 223 - DNA, 3443 bp, Homo sapiens
agtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcaccttggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcccacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaagtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgct

SEQ ID NO: 224 - DNA, 1477 bp, Homo sapiens
ccccgcttccagtcagagttcaagttaaaacagaaaaaaggaagatggcaagaatattgttacttttcctcccgggtcttgtggctgtatgtgctgtgcatggaatatttatggaccgtctagcttccaagaagctctgtgcagatgatgagtgtgtctatactatttctctggctagtgctcaagaagattataatgccccggactgtagattcattaacgttaaaaaagggcagcagatctatgtgtactcaaagctggtaaaagaaaatggagctggagaattttgggctggcagtgtttatggtgatggccaggacgagatgggagtcgtgggttatttccccaggaacttggtcaaggaacagcgtgtgtaccaggaagctaccaaggaagttcccaccacggatattgacttcttctgcgagtaataaattagttaaaactgcaaatagaaagaaaacaccaaaaataaagaaaagagcaaaagtggccaaaaaatgcatgtctgtaattttggactgacgttttaagaatttgttaccttacagaagagcaagggcttaggggttggaggtggcagataaaagaggattttcaactcaaatcttgtttcctgctggcctggtctgcccacgagctagagcggggaaatgttgagctcaaatgggtaaattgagaccagaaaattattttttcaacctagagaatctcctcttacagggggatgcatataacagatcatgtatgtgtagttatttctaagtagtaattcttcccagctctttgatttgccatatataaaataggtgggtcgtatgtcttccctttagacatgatgttttctactcatttgtctctctggccaattgaattattaataaaaggtctgtattatcaaagagtattctagtatttttgttacttttaatatttgatgccttttggaggtaaagctgttgggggaagaagagtttttggacccatagatgtttggatgatgtctctaatttgtcatttagaaaaatctcaaaaatgatttcagttgaataacttgccttctaaatgatcaatttacttctcccccaattttaaagaagtatgtgtatatttaataggggaaggtagtttatggaaatatttttaatggaatagttttcccttaatatgtatccttgctggatattattcaagctgcaagtcatcaaaagacccagaaaaaaaaaagtctgtaggttattttctctacttctatttcaactttgaatttcctcttcctgtgcaaattcctctagtcaagtgtgatatatcaagaaatctgaggaggatgcaggttttgtggtcctgatgggcccacaagtttttctatatttaactggaaatatgctttgattttgtgttattaatataattcttttgatgtagtcatgagtttttctttgtttgcatataattaaaatgcctctacttaatgtca

SEQ ID NO: 225 - DNA, 6044 bp, Homo sapiens
gcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacaaattgaagccaaggaagcttgtgattggctacgggcaactggtttcccccagtatgcacagctttatgaagatttcctgttccccatcgatatttccttggtcaagagagagcatgattttttggacagagatgccattgaggctctatgcaggcgtctaaatactttaaacaaatgtgcggtgatgaagctagaaattagtcctcatcggaaacgaagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggcaccgactgagatggcacagtttccagagctcacatcggccaagcctcaactctgtatcactacagattaactgccagtctgtggcccagatgaacctgctgcagaaatactcactcctaaagctaacggccctgctggagaaatacacaccttctaacaagcatggttttagctgggccgtgcccaagttcatgaagaggatcaaggttccagactacaaggaccggagtgtgtttggggtcccactgacggtcaacgtgcagcgcacaggacaaccgttgcctcagagcatccagcaggccatgcgatacctccggaaccattgtttggatcaggttgggctcttcagaaaatcgggggtcaagtcccggattcaggctctgcgccagatgaatgaaggtgccatagactgtgtcaactacgaaggacagtctgcttatgacgtggcagacatgctgaagcagtattttcgagatcttcctgagccactaatgacgaacaaactctcggaaacctttctacagatctaccaatatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccagggtaatgcaaagaaaacaaagtttgggcaaaccagatcagaaagatttgaatgaaaacctagctgccactcaagggctggcccatatgatcgccgagtgcaagaagcttttccaggttcccgaggaaatgagccgatgtcgtaattcctataccgaacaagagctgaagcccctcactctggaagcactcgggcacctgggtaatgatgactcagctgactaccaacacttcctccaggactgtgtggatggcctgtttaaagaagtcaaagagaagtttaaaggctgggtcagctactccacttcggagcaggctgagctgtcctataagaaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaagaacctggaggactaatttacccaaaggagcctgtgcccttttactaacctctgtggatcacgatcgcgcacctgtggtgggtgtgagggttaatgtgctcttgtccaggtatttgattgaaccctgtgggccaggaaaatccaaactcacctacatgtgcagagttgacttaaggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcagattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactg

SEQ ID NO: 226 - DNA, 5128 bp, Homo sapiens
ccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaatcacatcgatcagacaacaacatggcaggaccccaggaaggccatgctgtcccagatgaacgtcacagcccccaccagtccaccagtgcagcagaatatgatgaactcggcttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggagttagccctgcgtagccagttaccaacactggagcaggatggtgggactcaaaatccagtgtcttctcccgggatgtctcaggaattgagaacaatgacgaccaatagctcagatcctttccttaacagtggcacctatcactctcgagatgagagtacagacagtggactaagcatgagcagctacagtgtccctcgaaccccagatgacttcctgaacagtgtggatgagatggatacaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaaaaaaaaaaaaaaaaaaaaaaaaaaaaaaaaaaaaaa

SEQ ID NO: 227 - DNA, 2604 bp, Homo sapiens
gccaatgggcgcgcggggaggcgcgggccgcggcggcgggctgggggctcggcgctcccgggcgtcagtcgggccgcggcgacggcggcaggagcgcgtcccggcgccgcctcgggctccgctcggctcgggggctgcttcgggaggaggagagccaagggaggcgccaggcccgcgggccgggcgcatggcttagggacgctcccggccgccgcagccccagcatggggaaacttcactccaagccggccgccgtgtgcaagcgcagggagagcccggaaggtgacagcttcgccgtgagcgctgcctgggctcggaagggcatcgaggagtggatcgggagacagcgctgcccgggcggtgtctcgggaccccgacagctgcggttggcgggcaccataggccgaagcacccgggagctcgtgggcgacgtgttgagagacacgctcagcgaggaagaggaggacgactttcggctggaagtggccctgcctcctgagaagactgacgggctgggcagcggagatgagaagaagatggagagagtgagcgaaccctgcccaggctccaagaagcagctgaagtttgaagagctccagtgcgacgtgtccatggaggaggacagccggcaggagtggaccttcaccctgtatgactttgacaacaacggcaaggtcacccgagaggacatcaccagcttgctgcacaccatctatgaggtggtggactcctctgtcaaccactccccaacatccagcaagatgctgcgggtaaagctcaccgtggcccccgatggcagccagagcaagaggagcgtccttgtcaatcaggctgacctgcagagcgcaaggccccgagcagagaccaagcccactgaggacctgcggagctgggagaagaagcagcgagccccgctcaggttccagggtgacagccgcctggagcagtctggctgctaccaccattgcgtagatgagaacatcgagaggagaaaccactacttagatctcgccgggatagaaaactacacgtcccaatttgggcctggctccccttccgtggcccagaagtcagaactgcccccccgcacctccaatcccactcgatctcgctcccatgagccggaagccatccacatcccacaccgaaagccccaaggcgtggacccggcctccttccacttccttgacaccccaatcgccaaggtctcagagctccagcaacggctccggggcacccaggacgggagcaagcactttgtgaggtcccccaaggcccagggcaagagtgtgggtgtgggccacgtggccagaggggcaagaaacaagccccctctgggacccgccatccctgcggtgtccccctccgcccacctggctgccagcccggccctcctcccctccctagcccccctcgggcacaagaagcacaagcaccgagccaaggagagccagcagggctgccggggcctgcaggcaccactggcctcaggtggccctgtcctggggcgggagcacctgcgggagctgcccgccttggtggtgtatgagagccaggccgggcagccggtccagagacatgagcaccaccaccaccatgaacatcaccaccattaccaccacttctaccagacatagagcccctccccagggccccaccctgccatatgaaggaccccacccccgacaccacaaggcattattattctattaattattgttattatgatgattattgttattaataattattgttactccactaatatttagctagcctacatgtagaagatctatggaaacacagaactaaacttttatttatatgttgtggggactgcataactagcccaggaaatgactctggttttgagtggcctgtaatgggcagaggctccctcggggctcgggatctgcagcatctatgtggatcagcccacacccttcccagagccagggagcccttagcctcaactctgccccaccccagcctcttccaggagagcacccttacttggcccggcttccagagaccctcgaaatctccgagaagataaacagctgctacctcttagtattattctgattttattttgcccttaactgattgttatatgctacaagggatttcagtggactgcagagtgcgaacgtcttgctgttgtgtttttatgtcccaacctagaaaccttagctgtcttttctggagttgtctttcatgcttttccagtgggatcaagcccttttccccaagagtcccatctcttctgccatgcacgacatgaaaatccacttctcttccttctccttcttctctctctactttacagtgatacacacacgtatttaaggactatccctgagaccatccctctcattttggaaactgctagggagggaaccaaccacttaaacaagcgtggttttccaagatccaggcaattgtgtgctgttggttgtggtggaggatgtggcacatatatacgtacctacacggttctctaacagagctttctgtatctatagatagatgccatctgtccatttctatgtatctttctataaatatacactctcaggtatctttaaaaaaaaaaaaaaaaaa

SEQ ID NO: 228 - DNA, 2232 bp, Homo sapiens
cttccccttctctgccctgctccaggcaccaggctctttccccttcagtgtctcagaggaggggacggcagcaccatggacccccgcttgtccactgtccgccagacctgctgctgcttcaatgtccgcatcgcaaccaccgccctggccatctaccatgtgatcatgagcgtcttgttgttcatcgagcactcagtagaggtggcccatggcaaggcgtcctgcaagctctcccagatgggctacctcaggatcgctgacctgatctccagcttcctgctcatcaccatgctcttcatcatcagcctgagcctactgatcggcgtagtcaagaaccgggagaagtacctgctgcccttcctgtccctgcaaatcatggactatctcctgtgcctgctcaccctgctgggctcctacattgagctgcccgcctacctcaagttggcctcccggagccgtgctagctcctccaagttccccctgatgacgctgcagctgctggacttctgcctgagcatcctgaccctctgcagctcctacatggaagtgcccacctatctcaacttcaagtccatgaaccacatgaattacctccccagccaggaggatatgcctcataaccagttcatcaagatgatgatcatcttttccatcgccttcatcactgtccttatcttcaaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtgaccctcgccaggccccagccccagtgctgggaggggtggagctgcctcataatctgcttttttgctttggtggcccctgtggcctgggtgggccctcccgcccctccctggcaggacaatctgcttgtgtctccctcgctggcctgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaacagtctattgcattgatttataaatagttgtcagttcacatagcaatttaatcaagtaatcattaattagttaccccctatatataaatatatgtaatcaatttcttcaaatagcttgcttacatgataatcaattagccaaccatgagtcatttagaatagtgataaatagaatacacagaatagtgatgaaattcaatttaaaaaatcacgttagcctccaaaccatttaattcaaatgaacccatcaactggatgccaactctggcgaatgtaggacctctgagtggctgtataattgttaattcaaatgaaattcatttaaacagttgacaaactgtcattcaacaattagctccaggaaataacagttatttcatcataaaacagtcccttcaaacacacaattgttctgctgaagagttgtcatcaacaatccaatgctcacctattcagttgctctgtggtcagtgtggctgcatagcagtggattccatgaaaggagtcattttagtgatgagctgccagtccattcccaggccaggctgtcgctggccatccattcagtcgattcagtcataggcgaatctgttctgcccgaggcttgtggtcaagcaaaaattcagccctgaaatcaggcacatctgttcgttggactaaacccacaggttagttcagtcaaagcaggcaacccccttgtgggcactgaccctgccactggggtcatggcggttgtggcagctggggaggtttggccccaacagccctcctgtgcctgcttccctgtgtgtcggggtcctccagggagctgacccagaggtggaggccacggaggcagggtctctggggactgtcggggggtacagagggagaaggctctgcaagagctccctggcaatacccccttgtgtaattgctttgtgtgcgacagggaggaagtttcaataaagcaacaacaagcttcaaggaattc

SEQ ID NO: 229 - DNA, 2703 bp, Homo sapiens
gcagcgcggagtcccggcccgggacacaagatggcggcagcggcgctggggagggcgaggcggaggcggcaaaacgggcggtcgagcagaacgtgtagccgcgtcccctccagtccgctccgggcagctgctgatgcaaggaatcccctgggctcccgtccactccactgctgaccagcccattcgcctgtgctgagtcttcctgcaggcctttccttgcctctgtgggaccctgtgggggtccatccggctggagaagaaaagcctctcatgctaacgttgcagaccccagagggtcctgtgtgggtgtggagatggccaatgagaatcacggcagcccccgggaggaagcgtccctgctgagtcactccccaggtacctccaatcagagccagccctgttctccaaagccaatccgcctggttcaggacctcccagaggagctggtgcatgcaggctgggagaagtgctggagccggagggagaatcgtccctactacttcaaccgattcaccaaccagtccctgtgggagatgcccgtgctggggcagcacgatgtgatttcggaccctttggggctgaatgcgaccccactgccccaagactcaagcttggtggaaactcccccggctgagaacaagcccagaaagcggcagctctcggaagagcagccaagcggcaatggtgtgaagaagcccaagattgaaatcccagtgacacccacaggccagtcggtgcccagctcccccagtatcccaggaaccccaacgctgaagatgtggggtacgtcccctgaagataaacagcaggcagctctcctacgacccactgaggtctactgggacctggacatccagaccaatgctgtcatcaagcaccgggggccttcagaggtgctgcccccgcatcccgaagtggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggaggaagccaagcgcctgctctttaaatatgcggaggccgccaggcggctcatcgagtccaggagtgcatcccctgacagtaggaaggtggtcaaatggaatgtggaagacacctttagctggcttcggaaggaccactcagcctccaaggaggactacatggatcgcctggagcatctgcggaggcagtgtggcccccacgtctcggccgcagccaaggactccgtggaaggcatctgcagtaagatctaccacatctccctggagtacgtcaaacggatccgagagaagcaccttgccatcctcaaggaaaacaacatctcagaggaggtggaggcccctgaggtggagccccgcctagtgtactgctacccagtccggctggctgtgtctgcaccgcccatgcccagcgtggagatgcacatggagaacaacgtggtctgcatccggtataagggagagatggtcaaggtcagccgcaactacttcagcaagctgtggctcctttaccgctacagctgcattgatgactctgcctttgagaggttcctgccccgggtctggtgtcttctccgacggtaccagatgatgttcggcgtgggcctctacgaggggactggcctgcagggatcgctgcctgtgcatgtctttgaggccctccaccgactctttggcgtcagcttcgagtgcttcgcctcacccctcaactgctacttccgccagtactgttctgccttccccgacacagacggctactttggctcccgcgggccctgcctagactttgctccactgagtggttcatttgaggccaaccctcccttctgcgaggagctcatggatgccatggtctctcactttgagagactgcttgagagctcaccggagcccctgtccttcatcgtgttcatccctgagtggcgggaacccccaacaccagcgctcacccgcatggagcagagccgcttcaaacgccaccagttgatcctgcctgcctttgagcatgagtaccgcagtggctcccagcacatctgcaagaaggaggaaatgcactacaaggccgtccacaacacggctgtgctcttcctacagaacgaccctggctttgccaagtgggcgccgacgcctgaacggctgcaggagctgagtgctgcctaccggcagtcaggccgcagccacagctctggttcttcctcatcgtcctcctcggaggccaaggaccgggactcgggccgtgagcagggtcctagccgcgagcctcaccccacttaacatatcctgcggggaggaggagccccaggggtgctagtctggactgctgggactcgggcccctggggcctcagagggaccccggctgccactgacatatgaagattatggttctgccagggctcccctccctgcctgtccccaagtcctcacctcaaactccctccaagtcccatgtatataggtcctgatgccttcccaaccccgcccctcaccctgttgccaccttgtttcatttgtaaaaggaaatacagaaacccccccaagaaaaaaaa

SEQ ID NO: 230 - DNA, 2223 bp, Homo sapiens
gctcgccagggaagggccctacccagaggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagagcatagccacctaggggaggaggccgtgtgaagacagaggcagagattggagtgacgcatctccaagccaa

SEQ ID NO: 231 - DNA, 1511 bp, Homo sapiens
ccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccatgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaaaaaaaaaaaaaaaaaaaaaaaaaaaaaaaa

SEQ ID NO: 232 - DNA, 3505 bp, Homo sapiens
cgtcaggggcaggggagggacggcgcaggcgcagaaaagggggcggcggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaactttaaaaa

SEQ ID NO: 233 - DNA, 6960 bp, Homo sapiens
acttccgccccctccccctgccattggaactagctgagccgaactagttgcggccaccgagcagccggctctcggcacctcctcctccgcctccctgtctcctgttccattcgcctttcctcttctttcctggcccacgccgctccgaggcctcgcgaccgccgagcctgcagcctgccccgcggccaacatgagcttcttgtttggtagtcgctcttctaaaacttttaaaccaaagaagaacattccagagggttctcaccagtatgagctcttaaaacacgcagaagccacacttggcagtggcaaccttcggatggctgtcatgcttcctgaaggggaagatctcaatgaatgggttgcagttaacactgtggatttcttcaatcagatcaacatgctttatggaactatcacagacttctgtacagaagagagttgtccagtgatgtcagctggcccaaaatatgagtatcattgggcagatggaacgaacataaagaaacctattaagtgctctgcaccaaagtatattgattacttgatgacttgggttcaggaccagttggatgatgagacgttatttccatcaaaaattggtgtcccgttcccaaagaatttcatgtctgtggcaaaaactatactcaaacgcctctttagggtttatgctcacatttatcatcagcattttgaccctgtgatccagcttcaggaggaagcacatctaaatacatctttcaagcactttattttttttgtccaggaattcaaccttattgatagaagagaacttgcaccactccaagaactgattgaaaaactcacctcaaaagacagataaaaggatgcagagctgtgcaaattgttcctcaaatgaagcagtgtggagtgtattggggattttgttatattttgtttttatctggattgtttttgtcctaggtttgggggcgggggcttgtttgggttcctttttctttattctgattatgtgaaaccatattctattgctaggggaagccaagaaccattctctatacacttgataagggtaaatttatcttagtgtttttaaacttggttttggttacttgaggagttttttaataatattgtgtgctgcaagaaagtgcttgttgattgaactgccgatggattggtttctgtgtggtataaattgtggcccatttatgaagtccccaaaagagttatgtttttaagtgccttggcaggctcacttctgaggtgcaaaacatagatatagaactgaacagggcttgaaacaatattaggattactacccagggcacttactggtgcatgttgtaacatatctatgataaaagccatagtttacctaaaatggtgatttccagcctttactgctttgaagaaacagaatttgtaaaggtatgcatgtagaacataaaaaatatttcttaattattttttatattgatggtaatatattacgttcaacaatgcttaaagctctacaagcaggtcttttcccacctcttgatatctgtgatactgaaacttgaggatgttgaaatgtattacattttggcttctttctacatgttaactgcactgtagatgtaaaaattcaggttatatataggattgccatcttcagaggtgatgctgaactgtgaggtttcctagtaattgccaaatgagccgtaagtctgcagaattcccttctactttgaagagaaggggataggaatgtatatttggctgggggcatggagatgttcgtatgtatgaggagttagggatggggagtcaagttctagaaagttttgtctgaaaacctttgaatagaatggcatgaagattttaatcaattacttataaacaaagtcttagagacttccttttaggaatcaacttccatgagaagttaaaaataaattattaattttaggtacagacattaaacatggaatttaaggactgttgggggaaattgatcacttcttagcatttccattcagtgaatggagctgatgtttgcctgtcattttaagatgataccataccttctttggttattataggtccagtttgaagcattctgacttctggtttttccaccctgaaaggaaatgtttttctttgcagcagtattagataatgaaaaatgctaattcagtagttattaacttctaaattttattcgccatgactttctagtgaattattaccataaataacaatttcagaaacttagtttttagaataaatattaatttttccacttcagttttattctagaaaataccctttttagaaatccagttttagttttgtcattttcgataaatctttcttcagttagaaatatatatccttccttcagttgaaacatatacctttttcacatctaggaagaaatgcttgctctgaaatagtatagattaaaaacactcagtagaaaagaatctaaaattaaatgaatttgttttgccattaaagtagagcagtgatacaatttaatgccattacaattatgttgactagaaactgcctttttctccacttcatttctagcaattatttaccaagtaccaacagtagaagtaacaggaaagcctggcagagttaaatatcttggacatttattggtaaagcttatttataaactgcagtcagagctagttaatttccttaaatctttttgtattcagatagataatatgaatcattatgggttgattcagaaataaaatttgtgaggtgattttgaatcttgtccatataggaaaatgaagcacagaattactcagtcttccatattgtatttgacttcatatcaatctagtaaaaaaggagttgcaatagccaagtatagagagaatagtgaaaaattaatcttgccctttcaagccttatacagtagtacactgtacttgtttttagtagtaagacctactttcccactatatgtagatagtttgttttcactgtgccagaatctcaggtgcctgcttagagtatttctttaatcacagtcactgggaagtaaggagatgtatatatgtgtatatatggtaacaaagcatagcagttctctaggggagaggcctggcattgcacatggtgttacatggctacaagtaaggaaaaaatcagaaagtgaaagaactgatgtaataaaaggttgatttggttggttcccatgaaagttagtaagatgcccttttaaatataaggatcagtgctttgttctgcagcagagtttgctgataaatgtctgttggattctttttggatttctttaattaatttgtaagtaaccaagataattattttcccccttgctctctatattaatacgtagctataaagcaacagttggttttcttatcctttgataaaagcatcccataaaatataaagtagtaagttaacatagtattattgtcacacacaatgctttttttggttaaatgttgatacgaagcaatgttttggaattactttaattgatggagtagtggtggtagagagaaattaataacaaaaagagtgaaaatattttaattagcagtagatggtgctactggctttcatttgctgacttgattattccctttctcttaaaaaccatggcattagactgcactaaattaacaagcatgttagttgctggtagaggttttggaggttaatttaccttaaattggaagacttttaattgcagtctctttctaccttccctctgttagtcatttgtaaattctaaatggtcaccataaaatgtattaggtaggagaagatacgttttatgtataatatatctcagactgagttactgcctgtcttatcaggatggataaaacactacagtctcttatcaggaaatagagatgatgtggatatttatatattacatatataaccaccagactccattttatatattagcattttccttgcttatgggaaaatagcaaaacaacatttcatttatacttttgtttacccctctctgagacaggttttgataaccactgaaatggtagaatatgtgagatacaaatattgagttgtagaactttctttttaaggtgaataagtcatgccttaacatccaaataagagttcatcttcagagtggttcttttgggagcactgtttattccagctatactgcaaaagtataatgtttttggaactgttctagagcataccatgaaaagcagtttgttattatgcaggaaaatcagtttcatcattttagttacactaaacacttttggcagcttaatatgacctttttaaattttttttattttttttatttttatttctttaagatggagtcttgctctgttgcccgggctggagtacaatggcatgatctcagctcactgcaacctccacctcctgggttcaagcatttctcctgcctcagcctcccaagtagctgggattacaggcagcaccacacctggctaattttcatatttttagtagagatggggtttcaacatattggccaggctggtctcaaactcctgacctcaagtgatccgccctccccagcctcccaaagtgctgggattacaggtgtgagccaccacagccagccagtatgacctatcttaatcatcagctcaactgtaatttaaatttggctgttctctggagctaaaccattagggaagttcaaaggaatgtgccatgatttccgaatttgcacaagagaatgttttaagcattggtagcataattgaataaaagaatagtttcctgatgtcactattttgaagtggaaattatcacttggatgtggaggttttactttttaaaaacattcagcttaattaccttaccttaattaccttagttagatatactaatggaaaaaaaccaagtcctttctctagaacttgttttctatttttgttccttttcatgaaaacttctcaatttaattttaactactgtaggatagtattgattgaatggatactatggaaaagtggatccaatatttaagatagaagtagtttaaggagacaacagcctttactgccatttttttttaaatgttttcactcagatgaacaatttgactttaataaaagactggagatttttgtacaaagaaataggaataagtttcatatactaattatgctgagttttaagcctacatatcacaaaatatttagaattgtataaccttttcatatatttataacttttaatgtctttttaaaagatgtgggaccaaaaatatatttataatttggaaatgtgactgcataccaataagaaaacttaccttattttgaaatttatctgggatattaaagaatctaccaattcttaaaaacacagatttatactttaagcttattttaaaattaaagaatatataccaattcttagaaacactttaaggactactcttaaataacttaaatatcagagttttgttgtaatattaaaatttaccgtggaaatcactgttgttcagctatcaccttaattgtgtatgatatgataaatgtttagcagtaaagctatcttaagatttaatggaaaagtttaatttgaagatgtaacaaaaattctgaccacagttgattctgaatttttaaggctttcctaataggctgatcacagagaataatccattttgaaggtataaaactgcactgtatgtctgtcacttgtagctgaactgattcacattttgacaaaagagagaaaatacaaaaatgagttttgcaaatgtaataactttttctgcatatagaactaaataattgaaaaatatgggctatagttctcaaaggtagatagtaaaatcactggctttttccagctgtatgtttttccactgtgcgtgtacacacacactggaaaataattaggctgattttgcaggtcttcattgttagagattctgaagtatttactgtcaattcataggtttcagtttatttaggaaattagtgtttgacagctttttttaaattatttcactgaagctgagattattagtgatacaaagttaaaatttcaatatttaatttctctatatattattaatattaaattgttttttacttataaattcatgttctcatctgatttaatattaaatttgtataggtgggcgtttcttaccattttgcacaagtttttgtttttctgaaatacttaattgtgcaggttgtaaaaaagattagtgcattttcattttaaggatgctttgctccttaaattgttcgacagaaatgactttttagggaaagtagtttttttggagctactaacttgtatttattattgtacatgcataaccagggtggtgagggcactaatcttgtaggaaacacttacttgatgttttatttgaacttttcctataggtttaacttttactgcatagaattaacactaggaacagtgtcatgaaatctgggttgaaggagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcatttttgtttaaaaagggatactgatgtcagaaaatctgtaatatgttttattcaaaagatgtaaataatgtatacagacttgtatgtgatgggatgggaaatatttaaattctaggtgtttttttttttttaaagaagaaactcaatgtttataagaaaaaaatgaataaatagttacgtttggccatgaatcctgaaa

SEQ ID NO: 234 - DNA, 2053 bp, Homo sapiens
acatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctcaaaaaaaaaaaaaaaaa

SEQ ID NO: 235 - DNA, 1433 bp, Homo sapiens
cgcctttgcccgaagcccggggacgaaccgacggaccgaccgcctggcgcacggacgcgggcgctcgctttgtgttcggggctagcgtcggcgaggcttgagcttgcagcgcgcggcttccctgctttctcgcggccaccccggctccggcggcctcggcgcgcgaggggctggaggtgcgggagccgctctccgccggtcggtccccgcgcggctgagcccaggccgccagcgccgcggccccgtgcggtgtccctgagctcctgctccccgccgggctgctccgagcaacggtgcttcggagctccaaactcgggctgccggggcaagtgtcttcatgaacccagaggatgtccgggaagcactacaagggtcctgaagtcagttgttgcatcaaatacttcatatttggcttcaatgtcatattttggtttttgggaataacatttcttggaattggactgtgggcatggaatgaaaaaggagttctgtccaacatctcttccatcaccgatctcggcggctttgacccagtttggctcttccttgtggtgggaggagtgatgttcattttgggatttgcagggtgcattggagcgctacgggaaaacactttccttctcaagtttttttctgtgttcctgggaattattttcttcctggagctcactgccggagttctagcatttgttttcaaagactggatcaaagaccagctgtatttctttataaacaacaacatcagagcatatcgggatgacattgatttgcaaaacctcatagacttcacccaggaatattggcagtgctgtggggcttttggagctgatgattggaacctaaatatttacttcaattgcacagattccaatgcaagtcgagagcgatgtggcgttccattctcctgctgcactaaagatcccgcagaagatgtcatcaacactcagtgtggctatgatgccaggcaaaaaccagaagttgaccagcagattgtaatctacacgaaaggctgtgtgccccagtttgagaagtggttgcaggacaatttaaccatcgttgctggtattttcataggcattgcattgctgcagatatttgggatatgcctggcccagaatttggttagcgatatcgaagctgtcagggcgagctggtagaccccctgcaaccgctgctgcaagacactggacagacccagctttcgggaccctcccgcgtgccgaactgatcttcgagctgcatggacctaatcacagatgcagcctgcagtctcgcctaatggagctgccattaggggagtgtaaaactgggaaatgctgctcactgacagaattaaaaaaaaaaataaccagtatgaaagtcgttgcgccgtgaatctctactgtagccatgaatttatggacagttagatgcttaccaaaaaagaaaaaaaa

SEQ ID NO: 236 - DNA, 2563 bp, Homo sapiens
gccatcttctgcggccgttgcgacatggagggcgagatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccaccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccaggaagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagacagaccaggaggtgcacgtgcgtgagcgccgtttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcacccacgtagcgccggccaccagatcatcgtgcagaacgtcaccatggacgaggagacggcgctgggccccagaggggctgccgccgacaccatcaccatcgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgaagcgccccacccatgcctgcctggcctggtagagaagatggcacaggatggaggcgccccaagacggacagtgtacataagagtttcttgttgctttacaataaaacatgagaacctgcaaaaaaaaaaaaaa

SEQ ID NO: 237 - DNA, 5943 bp, Homo sapiens
atgactgatgataattcagatgataaaatagaagatgaattgcaaaccttctttaccagtgataaagatggaaatacacatgcatacaacccgaaatcaccacctacacaaaactcttcagccagcagtgtgaactggaattctgccaacccagatgacatggtggttgattatgaaactgaccctgctgtagttactggtgaaaatatttctttaagccttcagggtgttgaagtatttggtcatgaaaagtcttctagtgatttcattagtaagcaggtgttagatatgcataaagattctatttgtcagtgtcctgcacttgtaggtactgagaagcccaaatatctgcaacacagttgtcattccctagaagcagttgagggccagagtgttgagccatctttgccttttgtgtggaagcctaatgacaatttgaactgtgcaggctactgtgatgccttggagctaaaccaaacatttgacatgacagtggataaagttaactgcacctttatatcacatcatgccatcggaaagagtcagtccttccatactgctggaagcctgccaccaactggtaggagaagtggaagtacatcttctttatcctattccacttggacatcttcccattctgataagacgcatgcaagagaaactacttatgatagagaaagctttgaaaaccctcaagtcacaccatcagaagcccaagacatgacttacacagcattttctgatgtggtgatgcaaagtgaggtttttgtttcagatattggaaatcagtgtgcatgttcttcaggaaaggtcaccagtgagtacacagatggatcacaacaaagactagttggagaaaaggagacacaagcactaacaccagtttctgatggcatggaagtccccaatgattctgcattacaagagttcttttgtttatcccatgatgaatccaatagcgaaccacattcacagagctcatacaggcacaaggaaatgggccaaaatctgagagagacagtgtcctattgtcttattgatgatgaatgccctttaatggtgccagcttttgataagagcgaagctcaagtgctgaacccagagcataaagtcactgagactgaagacacacaaatggtctccaaaggaaaggatttgggaacccaaaatcatacctcagaattgattctaagtagcccgccaggacaaaaggtgggctcgtcatttggactgacttgggatgcaaatgatatggtcattagcacagacaaaacgatgtgcatgtcaacaccagtcctagaacccacaaaagtaaccttttctgtttcaccgattgaagcgacggagaaatgtaagaaagtggagaagggtaatcgagggcttaaaaacataccagactcgaaggaggcacctgtgaacctgtgtaaacccagtttaggaaaatcaacaatcaaaacgaataccccaataggctgcaaagttagaaaaactgaaattataagttacccaagaccaaacttcaagaatgtcaaagcaaaagttatgtctagagcagtgttgcagcccaaagatgctgctttatcaaaggtcacgcccagacctcagcagaccagtgcctcatcaccctcatcagtgaattcaagacaacaaacagtcttgagcagaacaccgagatctgacttgaatgcagacaaaaaagcagaaattctaattaacaagacacataagcagcagtttaataaactcattactagccaggctgtgcatgttacaactcattctaaaaatgcttcacacagggttccaagaacaacatctgccgtgaaatcgaatcaggaagatgttgacaaagccagttcttctaactcagcatgcgagaccgggtccgtttctgcgttgtttcagaagatcaaaggcatactccctgttaaaatggaaagtgcagaatgtttggaaatgacctatgttcccaacattgataggattagccctgaaaagaagggtgaaaaagaaaatgggacatctatggaaaaacaagagctgaaacaagagattatgaatgagacttttgaatatggttctctgtttttgggctctgcttcaaaaacaacgaccacctcaggtaggaatatatccaagcctgactcctgcggtttgaggcaaatagctgctccaaaagccaaagtggggccccctgtttcctgtttgaggcggaacagtgacaatagaaatcccagtgctgatcgagccgtatctcctcagaggatcaggcgtgtgtccagttctggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattctggtaatgccgctgtcatcaaatatgaggagaaacctccaaaaccagcatttcagaatggttcctcaggatccttttatttgaagcctttggtatccagggctcatgttcacttgatgaaaactcctccaaaaggtccttcgagaaaaaatttatttacagctcttaatgcagttgaaaagagcaggcaaaagaatcctcgaagcttatgtatccagccacagacagctcccgatgcgctgccccctgagaaaacacttgaattgacgcaatataaaacaaaatgtgaaaaccaaagtggatttatcctgcagctcaagcagcttcttgcctgtggtaataccaagtttgaggcattgacagttgtgattcagcacctgctgtctgagcgggaggaagcactgaaacaacacaaaaccctatctcaagaacttgttaacctccggggagagctagtcactgcttcaaccacctgtgagaaattagaaaaagccaggaatgagttacaaacagtgtatgaagcattcgtccagcagcaccaggctgaaaaaacagaacgagagaatcggcttaaagagttttacaccagggagtatgaaaagcttcgggacacttacattgaagaagcagagaagtacaaaatgcaattgcaagagcagtttgacaacttaaatgctgcgcatgaaacctctaagttggaaattgaagctagccactcagagaaacttgaattgctaaagaaggcctatgaagcctccctttcagaaattaagaaaggccatgaaatagaaaagaaatcgcttgaagatttactttctgagaagcaggaatcgctagagaagcaaatcaatgatctgaagagtgaaaatgatgctttaaatgaaaaattgaaatcagaagaacaaaaaagaagagcaagagaaaaagcaaatttgaaaaatcctcagatcatgtatctagaacaggagttagaaagcctgaaagctgtgttagagatcaagaatgagaaactgcatcaacaggacatcaagttaatgaaaatggagaaactggtggacaacaacacagcattggttgacaaattgaagcgtttccagcaggagaatgaagaattgaaagctcggatggacaagcacatggcaatctcaaggcagctttccacggagcaggctgttctgcaagagtcgctggagaaggagtcgaaagtcaacaagcgactctctatggaaaacgaggagcttctgtggaaactgcacaatggggacctgtgtagccccaagagatcccccacatcctccgccatccctttgcagtcaccaaggaattcgggctccttccctagccccagcatttcacccagatgacacctccccaaagtccacagactctctgaaagcattttgatgcaggtctgcaggactgaccccaaggaggaacgtgggcacaagaggtatatcagcacacgtgtgatcaccgtagggtaactggagcgtcaccaccggcggaatcgcagcttctgagactggaactctggaggaagacttttgcctccgtccaaaagattcctccaaaaaaagatttaaaaaaagatttcggcatcgacacggacgttgttgcacaaagcacttaaagaacgagagcatcttgttcattgcctttttcacctaagcatagggggaaaaactctcagggccctattaagatttataacctttgtaatgttcttcaccacagacaccttcttgtgagttttcagtctgactgtgggggtggggggtgtgaatgaaatggatgtcacagagtgtcatgtgtctgatgcagcctcctctgctgtgtattaaatgtcaaaatctgaatatatctggatatgtactaatcaaataataatcaatcaatcagcatatacatttcagccaaagccatagaagaaaaagcaatagttgcttgaattatgatcatctaccaccaactctgctcagccctgtaacagggtagggagagggtataacaggaagagctttgacttgtccctgtctatacattctctgtatcttttgggggtaacttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattg

SEQ ID NO: 238 - DNA, 963 bp, Homo sapiens
atgtcatttctaaatggcaccagcctaactccagcttcattcatcctaaatggcatccctggtttggaagatgtgcatttgtggatctccttcccactgtgtaccatgtacagcattgctattacagggaacttcggccttatgtacctcatctactgtgatgaggccttacacagacctatgtatgtcttccttgcccttctttccttcacagatgtgctcatgtgcaccagcacccttcccaacactctcttcatattgtggtttaatctcaaggagattgattttaaagcctgcctcgcccagatgttctttgtgcacaccttcacagggatggagtctggggtgctcatgctcatggccctggaccactgtgtggccatctgcttccctctgcgttatgccaccatcctcactaattcagtcattgctaaagctgggttcctcacttttcttaggggtgtgatgcttgttatcccttccactttcctcaccaagcgccttccatactgcaagggcaacgtcataccccacacctactgtgaccacatgtctgtggccaagatatcttgtggtaatgtcagggttaacgccatctatggtttgatagttgccctgctgattgggggctttgatatcctgtgcattacaatctcctacactatgattcttcaagcagttgtgagtctatcatcagcagatgctcgacagaaggccttcagcacctgcactgcccacttctgtgccatagtcctcacctatgttccagccttctttaccttctttacacaccattttgggggacacaccattcctctacacatacatattattatggctaatctctacctactaatgcctcccacaatgaaccctattgtgtatggggtgaaaaccaggcaggtacgagaaagtgtcattaggttctttcttaagggaaaggacaattctcataacttttaa

SEQ ID NO: 239 - DNA, 2518 bp, Homo sapiens
gggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagtgagcgccccctggggcacccaaaccaggatggggctcccacccctctccccagctccgcatccccggcgctaggacgcgttccccacgccgcgtccgggccaggagctcccttttccgtggacctttgctatcctctggtcttcgggccgcaccccctcccaacccattttccagtggggggcagcctgtgtcaccttcttcacgtccttcccgctcattgactgccctcgcccacgccgcctcaggaccctgttctgccccagagcccggagggcggagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacccaccaccacctcccttagcctcctgtgtgggaggagtttatgggtatgtggctcctgcccagtccaggtgggctttcacttctactctatttcagttcctctttcccgatctgggctggagagcttcctcattgttaaggcagcagaaactttcgctggatggttttaggataaggggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctgaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaaaaaaaaaaaaaaaaaaaaaaaaaaaaaaaaaaaaaaaaaaaaa

SEQ ID NO: 240 - DNA, 7603 bp, Homo sapiens
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 241 - DNA, 4552 bp, Homo sapiens
cggggggggggcggtgtgaaaggtgaccctcatttcgtttggaagcggtaacacttcggggtcacatctcagtccagttcctccagaataggcgctgctgtccgccccttccctgccccacgaaagaacaggtagccccaatcttgagacacgctcctccaccttcgaaatcttctcggtcccggttccccaggactcagccttcacagaggccaacttcaggtccgccactatcccaggattcccgactcccggtttcctgtccttctcccctcccagctcctggcgcctgcgatagcggcaagatggcggaccgtggcggcgtgggtgaagccgcagctgttggagcgtctcctgcatctgtccctggcctaaacccgacgctaggctggagggagcgactgcgggccgggctggcggggactggggcctcgttgtggttcgtggcggggctggggctgctttacgccctgaggatccctttgaggctgtgtgagaatttggcagcggtgactgtatttttaaattcattgacacccaaattctatgtggcacttacagggacctcttcattgatatcaggactaatatttatatttgaatggtggtacttccataagcatggcacatcttttattgagcaagtatctgtaagccatttgcaaccactgatgggaggaacagagagcagcatttcagaaccaggttctccttcgaggaacagagaaaatgaaaccagcagacagaatttgtcagaatgtaaggtatggagaaaccctctaaatcttttcagaggagcagaatataggagatacacttgggtgactggtaaagagccacttacatactatgacatgaacctgtcagctcaggaccatcagacctttttcacctgtgacacagattttttacgtccttcagacacagttatgcagaaggcttggagggaaagaaatcctccagctcgaatcaaagcagcctatcaagctttagaattaaacaatgactgtgccactgcatatgttctactggctgaggaagaagcaacaactattgtagatgctgaaaggttatttaaacaggcactcaaggcaggagaaacaatttataggcagtcacagcagtgccagcaccaaagtcctcagcatgaagctcaactgaggagagataccaatgtactggtatatattaaaagaagattggcaatgtgtgcaagaaaattaggaagaataagagaagcagtaaaaataatgagagatttgatgaaagaatttcctcctcttaccatgttgaacatccatgaaaatctcttagaatcacttttagaattacaggcctatccagatgttcaggcagtcctagcaaaatatgatgatataagccttccaaagtcagcagcaatctgttacacagcagcactgttgaagacaaggactgtttcagaaaaattctctccagaaacagcctccagaagaggattaagcacagcagaaattaatgccgtggaagcaattcatagagctgtggaatttaatcctcatgttccaaaatatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcacttttagaatgattccatacccgttagagaaaggacatctattttacccttatcccagctgcacagagacggctgatagagagctattacctacctttcatcatgtttctgtttacccaaaaaaggagcttcctttgttcatccatttcacagcaggattttgctcttctacagcaatgatagccattctcactcaccagtttcctgaaatcatgggtatttttgctaaagctgtgctgggactctggtgcccccaaccctgggcatcctcaggctttgaggagaatacacaggatttgaagtcagaagacctaggtttgagttctggctgagccacgcactgttcatgtgaccttggacaaatcaccaaatttttctgaacagcatctgtaaagtgacagtaacccctacctcacagggttgttgtgaggattacatatatgctaaagcattttgcatatgaaaaagcttcttatgaatattgttattcctaggcaaaccccccttggaagctgtcaaaaaggacaactgtagatgaaattgtcttccttttttcttcattcagcttagcctttctgtttggccagggctacttacaggggctgttggggttgaagtcaagtcaccgcattttggctcctttggtcaaagagaaagaactctaatgtccagctgctccatcgatatactcatagaatggaagtgagcaaaggaaaattttaagccaggatagttaaccgttagggggccagtgggagaatgcttgccttgcatttgcacatccagaatgactaaaacatcttaagtaaatgaggaatagccaccgagatgctcagagataatataagccatgagtgggaagtgggaaaatgagtttgtcaacgccctctcttttctatccctttacctttgaggtcagggacagggcatattactgacaccccactggctattgccctatacctgccaatcacccaaagaaaataatagcttctgagaaagctcaattcactgtagcaactgtgatatatttaccctaataaagccaccacttggtcttttccagtgcttctctcttatggagatcatccctggaatccaaagctctccagttttctaacccagttaagagttaaaaacaaccacaggtcatgagcagtaggcttggcagttataccccatgcagtcataggagactgctccatcattctcagcacatagggtgcacatctcactatctctggcatgaaccagccttgcgaacttatacagtctcagccactctgctttgatggtaattcttcaccactgatctctcctcaccatgcccttcctgcatccttcccccaaccacccaccagaggagttctggtccccaaaccaaagagttgcctgcaggttggtaatgtgactttgtagatattccttgattaaagccagaccctattggtatcctttttgaagtactggatcgaaatctaattgcttttttttttaattgttggggagaggaggatgagcagaactcctatgcagcctgagagaagttctctatgtgtctgtatatgtacacctctgtgtgtgtgtgtgtaacctcatggttgtgctcaggctgacagggagggcaaagagtgaaaaggaagcatctctttcttgttatccaacattgcttcaaagatgcccaacccccgtagtagcaggcagttcccaagtggagggtcggggcagaggcctccaccaaggccatcaataaccaggtgtgagctacaggtctctgtgtaatgtgaagctctcccgtatttcatttctgcacccagggggcggctctgcaggattgcttacggagaactctgtgtctggcacctctctccacaaggcccaggcgcccagggtcccaccgacctgcccaggaatgcatcacattgttctctggtgctgtaatttggctgcaggagctaggctgaatgcctcccagggatgagaaacatactctccctggcgtcctcccttcgccccagctagcttgagcttctgccctatgaccactgagtgcatttaaataaaaacctcagaaagactgaggaaaaaaaaatcctaattatctctcttctgttaagccatgtagagactcgtgtcctgagtgggtctgagaatttggcaaagacttactggttggtgttcttgataagggaagtgagacaaaggagaagaaattactccctgcaacaggaggaatagaaatgaagcagtgagtgttcagaaattagatctacaagaagttttgcaaacagaccctcagggccaggcaatgtttgtttttgttttttgttttttgtttttttttttaatctgaagcccctgattttatttttccagcatcactctaaggaagagtgtggattagtgccattattcagggctggtattaataaaagttagcttttatctgcagggctaggttaaggctggcattcttacttttacattaaaaaaactggctacaggctgcgcagctgaggtacttcagtcatgtgccttctctaaaggattcttagatccttaaaatatatagtatgttttaagtttgtatctaaatagcacttactgtaatgtattatacctaaatgtttattaaaagttagaagaaatgagtaccaacaggaaggaatggaagagaggagaggggctaagacattgctgatctgagggacagacctctatcaaatagaagagggctgggagaaggggtgattagaagcagagtgagggaactaaatggagccctgactgcaccaaataaagttctcattttgctgcttgttccaaaaaaaaaaaaaaaaaaaaaaaaaaa

SEQ ID NO: 242 - DNA, 2820 bp, Homo sapiens
gcgtttgaacctcttggcgggtgccggccatggcggcttcgctcccgggacctgggagccggcttttccgcacatatggggctgcggacggcaggagacagcggcggccgggccgggaagccgcgcagtggttcccgccgcaggaccggaggcgtttcttcaacagcagcggcagcagcgacgccagcatcggcgacccctcgcagtccgacgatcctgacgatcccgacgaccccgacttccccggcagcccggtgaggcggcggcggaggtgtcccggcggccgagtgcccaaggaccggcccagcctgaccgtgaccccaaagcgctggaagctgcgagctcgcccaagcctaaccgtgaccccaagacgcctggggctgcgagctcggcccccgcagaagtgcagcacaccctgcggcccgctccgacttccgcccttccccagccgcgactccggccgcctcagcccggacctcagcgtgtgcggccagcccagggacggcgacgagctgggcatcagtgcctccctgttcagctctctggcctcgccctgccccgggtccccaacgccaagggacagtgtcatctcgatcggcacctccgcctgtctggttgcagcctcagccgtcccgagcgacctccacctcccagaagtctccctggaccgagcatctctcccctgctcccaggaggaagcgacaggaggagccaaggacaccaggatggtccaccaaacccgcgccagcctcaggtcagttctctttggccttatgaactcaggaacccctgaggattctgagtttcgggcagatgggaagaatatgagagagtcctgctgtaaaaggaaactggtggtgggaaatggaccagagggtccaggtctgtcaagcacaggcaagaggagggccacaggccaggactcttgtcaagagagagggcttcaagaggccgtccggagagagcatcaggaggccagtgttcccaagggccgcattgtgccaaggggaacagacaggctggagagaactagatcaagccggaagagcaaacatcaggaggcaacggaaacctctctcctccattcccaccgctttaaaaagggccaaaagctgggaaaagattcgttccccacccaggacctgactcctttacagaatgcctgcttttggaccaaaaccagggcttccttcagtttccacaagaagaaaattgtgactgatgtgtcagaggtctgcagcatctataccactgccacttctctctctggatccctcctatcagaatgttcaaaccggcctgtcatgaacagaacaagtggtgctccgtcctcttggcactcctcctctatgtatttgctaagccccttaaacactctaagtatttcaaacaaaaaggcatctgatgctgaaaaggtttatggggaatgcagtcagaagggtcctgtcccctttagccattgccttcccacagaaaaactgcaacgctgtgagaagattggggaaggggtgtttggcgaagtgtttcaaacaattgctgatcacacacccgtagccataaaaatcattgctattgaaggaccagatttagtcaatggatcccatcagaaaacctttgaggaaatcctgccagagatcatcatctccaaagagttgagcctcttatccggtgaagtgtgcaaccgcacagaaggctttatcgggctgaactcagtgcactgtgtccagggatcttaccctcccttgctcctcaaagcctgggatcactataattcaaccaaaggctctgcaaatgaccggcctgatttttttaaagacgaccagctcttcattgtgctggaatttgagtttggagggattgacttagagcaaatgcgaaccaagttgtcttccttggctactgcaaagagcattctacaccagctcacagcctccctcgcagtggcagaggcatcactgcgctttgagcaccgagacttacactgggggaacgtgctcttaaagaaaaccagcctcaaaaaactccactacaccctcaatgggaagagcagcactatccccagctgtgggttgcaagtgagcatcattgactacaccctgtcgcgcttggaacgggatgggattgtggttttctgtgacgtttccatggatgaggacctgtttaccggtgacggtgactaccagtttgacatctacaggctcatgaagaaggagaataacaaccgctggggtgaatatcacccttatagtaatgtgctctggttacattacctgacagacaagatgctgaaacaaatgaccttcaagactaaatgtaacactcctgccatgaagcaaattaagagaaaaatccaggagttccacaggacaatgctgaacttcagctctgccactgacttgctctgccagcacagtctgtttaagtaagctaaatgtatcttactgccccgaaatgagaggagactggtcttgaagcctctggtgctgtttcaacctccgtccccacaggagggtggaactcccattctcacaggtttccagtcagcttttcaaacaagaattttgtttccaaatggaaactgaaatatttgttgaaatgtttaaatttgctgataacaaatgttctgaaagaagtaaactagccgggcgcagtggcgtgcgcctgtagtcccagctactcgggaggctgaggcaggaggatcgcttgagcccaagagttcatatctagcctggtcaacatagcaagacccctgtctctatttttttaaataaataaactacatgtgaaaacaaaaaaaaaaaaaaaaaaaaaaaaaaaaaa

SEQ ID NO: 243 - DNA, 1613 bp, Homo sapiens
gcgcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaaaaaaaaaaaaaaaaaaaaaaaaaaaa

SEQ ID NO: 244 - DNA, 1108 bp, Homo sapiens
gagtgagtgagagggcagaggaaatactcaatctgtgccactcactgccttgagcctgcttcctcactccaggactgccagaggctcactcccttgagcctgcttcctcactccaggactgccagaggaagcaatcaccaaaatgaagactgctttaattttgctcagcattttgggaatggcctgtgctttctcaatgaaaaatttgcatcgaagagtcaaaatagaggattctgaagaaaatggggtctttaagtacaggccacgatattatctttacaagcatgcctacttttatcctcatttaaaacgatttccagttcagggcagtagtgactcatccgaagaaaatggagatgacagttcagaagaggaggaggaagaagaggagacttcaaatgaaggagaaaacaatgaagaatcgaatgaagatgaagactctgaggctgagaataccacactttctgctacaacactgggctatggagaggacgccacgcctggcacagggtatacagggttagctgcaatccagcttcccaagaaggctggggatataacaaacaaagctacaaaagagaaggaaagtgatgaagaagaagaggaggaagaggaaggaaatgaaaacgaagaaagcgaagcagaagtggatgaaaacgaacaaggcataaacggcaccagtaccaacagcacagaggcagaaaacggcaacggcagcagcggaggagacaatggagaagaaggggaagaagaaagtgtcactggagccaatgcagaaggcaccacagagaccggagggcagggcaagggcacctcgaagacaacaacctctccaaatggtgggtttgaacctacaaccccaccacaagtctatagaaccacttccccaccttttgggaaaaccaccaccgttgaatacgagggggagtacgaatacacgggcgtcaatgaatacgacaatggatatgaaatctatgaaagtgagaacggggaacctcgtggggacaattaccgagcctatgaagatgagtacagctactttaaaggacaaggctacgatggctatgatggtcagaattactaccaccaccagtgaagctccagcctg

SEQ ID NO: 245 - DNA, 975 bp, Homo sapiens
atgcctctatttaattcattatgctggtttccaacaattcatgtgactcctccatcttttattcttaatggaatacctggtctggaaagagtacatgtatggatctccctcccactctgcacaatgtacatcatcttccttgtggggaatcttggtcttgtgtacctcatttattatgaggagtccttacatcatccgatgtattttttttttggccatgctctctccctcattgacctccttacctgcaccaccactctacccaatgcactctgcatcttctggttcagtctcaaagaaattaacttcaatgcttgcttggcccagatgttctttgttcatgggttcacaggtgtggagtctggggtgctcatgctcatggctctagaccgctatgtagccatttgctaccctttgcgttatgctaccacactcaccaaccctatcattgccaaggctgagcttgccaccttcctgaggggtgtattgctgatgattcctttcccattcttggttaagcgtttgcctttctgccaaagcaatattatctcccatacgtactgcgaccacatgtctgtagtaaagctatcttgtgccagcatcaaggtcaatgtaatctatggtctaatggttgctctcctgattggagtgtttgacatttgttgtatatctttgtcttacactttgatcctcaaggcagcgatcagcctctcttcatcagatgctcggcagaaggctttcagcacctgcactgcccatatatctgccatcatcatcacctatgttccagcattcttcactttctttgcccaccgttttgggggacacacaattcccccttctcttcacatcattgtggctaatctttatcttcttcttcccccaactctaaaccctattgtttatggagtaaagacaaaacagatacgcaagagtgtcataaagttcttccagggtgataagggtgcaggttga

SEQ ID NO: 246 - DNA, 8233 bp, Homo sapiens
ctcctggcccaagggactggggcctcaggctctcaggccaaggagagtggccccgaggactgtccggaggagggtggccagccctgctgcccagagggactgagccactggcagggaaggaggcggtgttccccctggcctgactttcctccaaaggacgtccccctgaggcttaggggctgagccatgcccttgtgctccctggaggacgcggccagagcccccacaccatgaacagcacccccaggaatgcccaggccccgagccaccgtgagtgcttcctgccctctgtggctcgcaccccctcggtcaccaaggtcacgccagccaaaaagatcaccttcctcaagcgaggggatccacggtttgctggggtccgcctggccgttcaccagcgcgcctttaagaccttcagcgccctcatggacgagctctcccagcgcgtgcctctctcctttggggtgcgctctgtcaccacaccccggggcctgcatagcctcagcgccctggagcagctggaagatggaggctgctacctctgctctgataagaagccccccaagacccccagtggaccaggccggccacaggagagaaaccccactgctcagcagttgcgggatgtcgaaggccagcgtgaagccccaggcacctcctcctcccggaagagtcttaaaaccccccggaggatactgctgattaagaacatggaccctcgcctccagcagacagtggttctcagtcacaggaatactaggaacctggccgcctttctcggcaaagcctcagatctcctgcgctttcctgtgaagcagttgtacacgaccagcgggaaaaaggtggactcgctgcaggccctgctgcacagcccctctgtgctggtgtgtgccgggcatgaggccttcagaaccccagccatgaaaaatgccaggagaagcgaggctgaaactttatctgggctgacttcaagaaacaaaaacgggagctgggggccaaagaccaagccgagtgtgatccattcgcggtctccgccaggcagcacgccacggctgccagaaaggcctggtcctagcaaccccccggtgggccctgctcctggcaggcaccctcaggacacgccagctcagtcgggcccgctggtggctggcgatgacatgaagaagaaggtccgcatgaatgaggacggcagcctgtccgtggagatgaaagtccgcttccacctggtcggcgaggacacgctcctatggtcccggaggatgggcagggccagcgccctcacggcagccagtggggaagaccccgttctgggggaggtagaccccctctgctgtgtgtgggagggctacccttggggcttctcagagcctggggtgtggggaccccggccctgcagggtgggatgcagggaagtctttggccgaggcgggcagccagggcccaagtatgaaatctggacgaatcccctgcatgcctcccagggagagagagtggcagctcggaagaggtggggactggcccagcacgtccgctgcagtggcctgtggggccacgggactgccgggagggagagatgcagccaggacagtgccagcccagcctccagcaccggcctccccgagggctcggagccagagtcctcctgctgccccaggaccccggaggacggggtggacagtgccagcccctctgcccagataggggctgagcggaaagctggagggagcctgggtgaggaccccggcctatgcatagatggagcagggctgggcggcccagagcaaggcggccgcctgacaccgagggcccggagtgaggagggggcttcttcggactcgtcagccagcaccggctctcatgagggatccagcgaatggggtgggcggccccagggctgtccaggcaaggcaagggccgagacctctcagcaggaggccagcgagggaggcgaccccgcttctccagccctgagtctttcatctttaaggagtgacgacctgcaggcagagacgcaaggacagggtaccgagcaggccacgggagcggctgtgacaagggagcctctggttctgggcctttcctgctcctgggactcggaaggagcctcttccaccccttccacctgcacttcatcccagcaggggcagagaaggcacagaagccgggccagtgcaatgtcctcacccagcagccctggccttggccgagtggccccgagaggccatcccaggcattctcactaccgcaaggacacccacagcccactggactcctctgtaaccaagcaagtgccgaggcctcctgagcggcgaagggcctgccaggatggctcagtgccacgatattctggaagctcatcgagcaccaggacacaggcctctgggaacctgagacctccctcctcgggctctcttccttcccaggaccttctgggaaccagcagtgccactgtcacccctgcagtccactcggattttgtttctggagtctccccgcacaacgctccctctgccgggtgggcaggggacgcggggtccaggacatgctcgccggcccccatacctccccacacatccgactcctgctcaaaatctggggctgccagcccgggggaagaggccagggacacgcctcagccctcctcacccttggttctgcaggttggacggcctgagcaaggggcggtgggcccccaccgaagccactgctgctcacagcctgggacgcagccggcccaagaggcccagcggggaccctcccctgaggctagctggctgtgtggcaggtactgtcccaccccgcccagggggcggccctgcccccagaggcgctcttccagctgtgggagcaccggcagcagccaccaaagcactgcccgggggccaggtgggagcccgcaggaggggacacgccagccaggccccacgccgtccccaggccccaattcaggggcatcaaggagaagcagtgccagccagggtgcggggtctcgggggctgtccgaggagaagaccttgaggagtgggggaggcccccaggggcaggaggaggccagtggtgtgtcacccagctctctgccccgctcgtctccagaggctgtggtccgcgaatggctggacaacattccagaagagcccatactcatgacatatgagttggcggacgagaccacaggtgcagctgggggtggcctgagaggccccgaggtggaccctggggatgaccattctctggaaggcctgggggagccagctcaggcgggacagcagtccctggaaggggaccccggccaggacccagagccagagggagccctcctggggagtagtgacactggtccccaatcaggagagggtgtcccccaaggggcagctccagagggagtttccgaggcccctgcagaggccggagcagacagagaggccccagcaggctgcagggtgagcctgcgggcacttcctggccgggtgtctgcctccacgcagatcatgagggcgctgatgggctccaagcagggccggcccagcagcgtgcccgaagtgtctaggcccatggccaggaggctcagctgctcagccggggccctcattacttgtctggccagtctgcagttatttgaggaagaccttgggtctcctgccagcaaagtgaggttcaaagactccccttggtaccaggagctgctcagcatctcgaaggacctgtggccaggatgtgacgttggggaagaccagctggactcaggcctctgggagctcacatggagccaggctctgccagaccttgggtcccatgccatgacggagaacttcacgcccacatcctcctctggtgtggacatcagcagcggctctggaggctcaggggagagtagcgtaccctgtgccatggacggcaccctggtgacacaggggacagagctgcccctgaaaacctccaaccagaggcctgattcaagaacttatgagagcccaggggatctggaaaaccaacagcagtgttgtttcccaaccttcttgaacgcccgagcctgcgcttgtgccaccaatgaggatgaagcagaaagagacagtgaggagcagagggcgagctcgaacctggagcagttagctgaaaacacagtgcaagaagaggtgcaattagaggaaactaaagaagggacagaaggagaagggctgcaagaagagggggtgcagttagaggaaactaaaacagaagaagggctgcaagaagagggggtgcagttagaggaaactaaaacagaagaagggctgcaagaagagggggtgcagttagaggaaactaaaacagaagaagggctgcaagaagagggggtgcagttagaggaaactaaaacagaagaagggctgcaagaagagggggtgcagttagaggaaactaaaacagaagaagggctgcaagaagagggggtgcagttagaggaaactaaaacagaagaagggctgcaagaagagggggtgcagttagaggggactaaagaaacggaaggagaaggacagcaagaagaagaggcgcagttagaggaaattgaagaaacaggaggagaagggctgcaagaagagggggtgcagttagaggaagttaaagaagggccagaaggaggactgcaaggagaggctcttgaagagggtctcaaagaggaaggacttccagaagaaggaagcgtccacgggcaggaattgtcagaggccagctctccggatgggaaaggctcccaggaagatgacccagtccaggaggaggaagcaggaagagcctctgcctctgcagagccgtgccccgcagagggcacagaggaacccacagagccccctagtcatctcagcgagacggacccaagtgccagcgagagtcagagtggctcccagcttgagcctggtttggaaaagccgcccggagccaccatgatgggccaagagcacacgcaggcccaacccacccagggggctgcagagaggagctcttcggtggcctgcagcgcggctctggactgcgaccccatctgggtgtccgtgttactgaagaagacggagaaggccttcctggcccaccttgccagtgcggtggctgagctccgagcacgctggggcctgcaggacaatgatctgctggaccagatggcggccgagctgcagcaggacgtggcccaacgcctccaggacagcaccaagagagagctccagaagctccagggccgggcgggtaggatggtgctggagcctccaagggaggccctcaccggggagctgctcctgcagacccagcagcgcagacaccgtctccggggcctgcgaaacctctcggccttctctgagcggaccctgggcctggggcccctctccttcaccctggaggacgagccagccctcagcacagccctggggagccagctgggcgaggaggcggagggggaggagttctgtccctgcgaggcctgcgtgaggaagaaagtgagccctatgtcccccaaggccacaatgggggcaaccagaggtcccatcaaagaggcctttgacctgcagcagattctgcagaggaagaggggagaacacactgatggggaggcagcagaggtggyccctggcaagacccacacggaccccacgagcactaggactgtccagggagctgagggagggctggggccggggctgagccaggggcctggagtggacgagggtgaggatggcgaggggagccagagactcaacagagacaaagatcccaaactcggggaggcagagggagatgcaatggctcaggagagagaagggaaaacccacaacagtgaaaccagtgcgggcagtgagttgggggaagctgagcaggagggagagggcataagtgaaaggggagaaactgggggtcaaggctctgggcatgaggacaacttgcagggtgaagctgcggcaggaggtgaccaagatccaggacagagtgatggggccgaaggcatagaggccccggaggctgaaggggaggcccagccagagtcagaaggtgtagaggccccagaggcagaaggggatgcccaggaggctgaaggggaggcccagccagagtcagaagatgtagaggccccagaggcagaaggagaggcccagccagagtcagaagatgtagagaccccagaggcagaatgggaggtccagccagagtcagaaggtgcagaagccccggaggcagaaaaggaggcccagccagagacagaaagtgtagaggccctggagactgaaggggaggacgagccagagtcagaaggtgcagaggcccaagaggcagaagaggaggcccaggaggcagaagggcaggcccagccagagtcagaagttatagagtcccaggaggcagaagaggaagcccagccagagtcagaagatgtagaggccctggaggttgaagtggagacccaggaggcagaaggggaggcccagccagagtcagaagatgtagaggccccagaggctgaaggggagatgcaagaggcagaagaggaggcccagccagagtcagacggtgtagaggcccagccaaagtcagaaggtgaagaggcccaggaggttgaaggggagacccagaagacagaaggggatgcccagccagagtcagacggtgtagaggccccggaggcagaagaggaggcacaggaggctgaaggggaggtccaggaggcagaaggggaggcccacccagagtcagaagatgtagatgcccaggaggcagaaggggaggcccagccagaatcagaaggtgtagaggccccagaggcagaaggggaggcccagaaggcagaaggtatagaggccccagagactgaaggggaggcccagccagagtcagaaggtatagaggccccagaggctgaaggggaggcccagcctgagtcagaaggtgtagaggcccaggatgcagaaggggaggcccagccagagtcagaaggtatagaggcccaggaggctgaaaaggaggcccaaccagagttagaaggtgtagaggccccagaggcagaaggggaggcccagccagagtcagaaggtatagaggccccagaggcagaaggggaggcccaaccagagttagaaggtgtagaggccccggaggctgaagaggaggcccagccagagccagaaggcgtagagaccccggaggctgaaggggaggcccagccagagtcaggaggagaaactcaaggtgagaaaaaggggagccctcaggtcagtctaggagatggccaatctgaggaggcttctgaaagcagcagcccagtccctgaggacaggcccactccacccccttccccaggtggagacactccccaccaaaggccaggctcccaaacaggcccttcctcctccagagcatcctcttggggcaactgctggcagaaagactcagaaaatgaccatgtacttggagacacaaggagccctgatgccaagtccacggggacccctcatgcagagaggaaggccaccaggatgtacccagaaagttctacttctgagcaagaagaggcccctttgggctcaaggactccagagcagggggccagtgaaggttatgacctacaagaggaccaggcactcggaagtctcgcccccactgaggcagtgggcagggcagacggctttggccaagatgacttagatttctagacaagatcaagctagaaaacaatcacgagcttgggagctctgtttttattcatattttttctacaaaactgagcaacgttcagtccactggagatgtccatagtacatggacaaagaccaaggacttgccaaggacacagcccatgccatgctgtcctgggactcttaagtccagaagtgtcagagagctctgcggcccgtcccacacgcagtgtgaagaaagggggtgtctgcggatctgcccggttatcggaggtcagcccggctcctatttatttgtctgcagagcccgaaagatggaactgattggaaaggctccagtttagcttttgtttgtgggtttgttttctgctagcaagtgttgctctctgtcttttccctgttgatctcctgttacttttctccttggcttctgttggcactcacctcatttgactttgaggtgctttttttctagtctggaatatatttgatgactctgcagaaatacttgggcaaagcaggtaacttcagagtcattggataaagtttgttctcaactccaaaaaaaaaaaaaaaaa

SEQ ID NO: 247 - DNA, 4039 bp, Homo sapiens
ggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaaa

SEQ ID NO: 248 - DNA, 3947 bp, Homo sapiens
gggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagaacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagtttttttttttctcttcttcttcttcttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatgga

SEQ ID NO: 249 - DNA, 1040 bp, Homo sapiens
cgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctcttccatctcccacactaacttgtgcattgactaatggaagcattgaagtccaatgcatgataccagagcattacaacagccatcgaggacttataatgtactcatgggattgtcctatggagcaatgtaaacgtaactcaaccagtatatattttaagatggaaaatgatcttccacaaaaaatacagtgtactcttagcaatccattatttaatacaacatcatcaatcattttgacaacctgtatcccaagcagcggtcattcaagacacagatatgcacttatacccataccattagcagtaattacaacatgtattgtgctgtatatgaatggtattctgaaatgtgacagaaaaccagacagaaccaactccaattgattggtaacagaagatgaagacaacagcataactaaattattttaaaaactaaaaagccatctgatttctcatttgagtattacaatttttgaacaactgttggaaatgtaacttgaagcagctgctttaagaagaaatacccactaacaaagaacaagcattagttttggctgtcatcaacttattatatgactaggtgcttgctttttttgtcagtaaattgtttttactgatgatgtagatacttttgtaaataaatgtaaatatgtacacaagtg

SEQ ID NO: 250 - DNA, 14135 bp, Homo sapiens
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggtgcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 251 - DNA, 2105 bp, Homo sapiens
gtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggatggggtgcatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggccagggggtgcccaggtggtggctgcaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgccaaagtctttaccaaaaaaaaaaaaaaaaaaaa

SEQ ID NO: 252 - DNA, 933 bp, Homo sapiens
atgcaactgaataataatgtgactgagttcattctgcttggattgacacaggatcctttttggaagaaaatagtgtttgttatttttttgcgtctctacttgggaacactgttgggtaatttgctaatcattattagtgtcaagaccagccaggcacttaagaacccaatgttcttcttccttttctacttatccttatctgatacttgcctctctacttccataacccctagaatgattgtggatgcccttttgaagaagacaactatctccttcagcgagtgcatgatccaagtcttttcatcccatgtctttggctgcctggagatcttcatcctcatcctcacggctgttgaccgctatgtggacatctgtaagcccctgcactacatgaccatcataagccagtgggtctgtggtgttttgatggctgtggcctgggtgggatcctgtgtgcattctttagttcagatttttcttgccctgagtttgccattctgtggccccaatgtgatcaatcactgtttctgtgacttgcagcccttgttgaaacaagcctgttcagaaacctatgtggttaacctactcctggtttccaatagtggggccatttgtgcagtgagttatgtcatgctaatattctcctatgtcatcttcttgcattctctgagaaaccacagtgctgaagtgataaagaaagcactttccacatgtgtctcccacatcattgtggtcatcttgttctttggaccttgcatatttatgtacacatgccttgcaaccgtattccccatggataagatgatagctgtattttatacagttggaacatcttttctcaaccctgtgatttacacgctgaagaatacagaagtgaaaagtgccatgaggaagctttggagcaagaaattgatcacagatgacaaaagataa

SEQ ID NO: 253 - DNA, 1550 bp, Homo sapiens
tgtttgttgggggagaaaggagagaaaggaaagcgcgaggagccgccgccaccaccagcgcagcagtcctggagctgtgaggagattcgggccgtcaccctgcctcccctgcgtcccgccaccggccgcttctgtcctcggacccattccaacaatctcgtaaaacatggtggattactatgaagttctaggcgtgcagagacatgcctcacccgaggatattaaaaaggcatatcggaaactggcactgaagtggcatccagataaaaatcctgagaataaagaagaagcagagagaaaattcaagcaagtagcggaggcatatgaagtgctgtcggatgctaagaaacaggacatctatgacaaatatggcaaagaaggattaaatggtggaggaggaggtggaagtcattttgacagtccatttgaatttggcttcacattccgtaacccagatgatgtcttcagggaattttttggtggaagggacccattttcatttgacttctttgaagacccttttgaggacttctttgggaatcgaaggggtccccgaggaagcagaagccgagggacggggtcgtttttctccgtgttcagtggatttccgtcttttagaagtggattttcttcttttgatacaggatttacttcatttgggtcactaggtcacgggggcctcacttcattctcttccacgtcatttggtggtagtggcatgggcaacttcaaatagatatcaacttcaactaaaatggttaatggcagaaaaatcactacaaagagaattgtcgagaacggtcaagaaagagtagaagttgaagaagatggccagttaaagtccttaacaataaatggtaaggagcaggtgctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgttgggaccacataataggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaaattttttcagcatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaagaaaataaatgcgaatgtgttggtgcattc

SEQ ID NO: 254 - DNA, 966 bp, Homo sapiens
atgctaacactgaataaaacagacctaataccagcttcatttattctgaatggagtcccaggactggaagacacacaactctggatttccttcccattctgctctatgtatgttgtggctatggtagggaattgtggactcctctacctcattcactatgaggatgccctgcacaaacccatgtactacttcttggccatgctttcctttactgaccttgttatgtgctctagtacaatccctaaagccctctgcatcttctggtttcatctcaaggacattggatttgatgaatgccttgtccagatgttcttcacccacaccttcacagggatggagtctggggtgcttatgcttatggccctggatcgctatgtggccatctgctaccccttacgctattcaactatcctcaccaatcctgtaattgcaaaggttgggactgccaccttcctgagaggggtattactcattattccctttactttcctcaccaagctcctgccctactgcagaggcaatatacttccccatacctactgtgaccacatgtctgtagccaaattgtcctgtggtaatgtcaaggtcaatgccatctatggtctgatggttgccctcctgatttggggctttgacatactgtgtatcaccaactcctataccatgattctccgggcagtggtcagcctctcctcagcagatgctcggcagaaggcctttaatacctgcactgcccacatttgtgccattgttttctcctatactccagctttcttctccttcttttcccaccgctttggggaacacataatccccccttcttgccacatcattgtagccaatatttatctgctcctaccacccactatgaaccctattgtctatggggtgaaaaccaaacagatacgagactgtgtcataaggatcctttcaggttctaaggataccaaatcctacagcatgtga

SEQ ID NO: 255 - DNA, 7387 bp, Homo sapiens
gagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaagaaatcagcctgaataaatggaatgacttgtctgcctcacatattctaaggtgcagagtcagaatatgaactgttgcaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattccaaagcaggctgccttgtggttttggccagccttgtgctatgttgataagattgatttactgcttaaaatcactttactttatccaatttttactgaactttttatgtaaaaaaataaaatcaattaaagaacttg

SEQ ID NO: 256 - DNA, 3472 bp, Homo sapiens
atacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaaaa

SEQ ID NO: 257 - DNA, 2393 bp, Homo sapiens
ctgatcatcccttaggaatgtctgaatctgaacaggctcttaaaggtacttctcagattaaattactctcatctgaagatatagaagggatgcgacttgtatgtaggcttgctagagaagttttggatgttgctgccggcatgattaaaccaggtgtaactactgaagaaatagatcacgctgtacacttagcatgtattgcaagaaattgctacccttctcccctgaattattataatttcccaaagtcttgttgtacctcagtgaatgaagtcatttgccatggaataccagacagaaggcccttacaagaaggtgacattgttaatgtggatatcactctttatcgcaatggttatcatggggacctgaatgagacattttttgttggagaagtggatgatggagcacggaaacttgttcagaccacatatgagtgcctgatgcaagccattgatgcagtgaagcctggtgttcggtacagagaattgggaaacattatccagaagcatgcccaagcaaatgggttttcagttgttcgaagctattgtgggcatggaatccacaagctttttcatacagctcccaatgtaccccactatgctaaaaataaagcagttggagtgatgaagtcgggccatgtatttacaattgagccaatgatttgtgaaggcggatggcaggatgaaacctggccagatggttggactgcggtgacaagagacggaaagcggtctgctcagtttgagcacaccctcctggtcacagacactggctgtgaaatcctaacccggcgacttgacagtgcacggcctcacttcatgtctcaattttaatttctcccaagatggcacatctcagtaccttcttactgtgctatgcattttattgagagtacagaaaggaagaggaacctttttttaatcacttgttttgttttgactatagataagaaaggactacagcatttgatgtgtgtcctcaagaacttgtcttgggtctgaaaaagctgagaagaataaaggaaacattgctcaactcttcagccccctccccctgcacacctgttttctcatttgccctttgagcacttttacttaaacttgcttgtagttgcttttatcactgccgcaaaacagccatcaagagccatctgctttccaggtgaacattggaaatgagaatctttgaaacttagcaatatgtgttgcaccagattttttaaattatatatatggaaatatatatgtatacattttaagttctgtatacataattaccaaacactatgtgacctggagtttgtgttgtttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaaaaaaaaaaaaaaaaaaaaaaaaaaaaaaaaaaaaaaaaaaaaaaaaaaaaaaaaaaaaaaaaaa

SEQ ID NO: 258 - DNA, 6462 bp, Homo sapiens
acatgacccggcggcagtagccgtggcagcagccgcggcggctccgcgagctcgccgggtgggctcagttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagaggttatcaatgccgggaagagcacacacaatgaagaccaagccagctgtgaggtgctcactgtgaagaagaaggcaggggccgtgacctcaaccccaaacaggaactcatccaagagacggtcctcccttcccaatggggaagggctgcagctgaaggagaactcggaatccgagggtgtttcctgccactattggtcgctgtttgacgggcacgcggggtccggggccgcggtggtggcgtcacgcctgctgcagcaccacatcacggagcagctgcaggacatcgtggacatcctgaagaactccgccgtcctgccccctacctgcctgggggaggagcctgagaacacgcccgccaacagccggactctgacccgggcagcctccctgcgcggaggggtgggggccccgggctcccccagcacgccccccacacgcttctttaccgagaagaagattccccatgagtgcctggtcatcggagcgcttgaaagtgcattcaaggaaatggacctacagatagaacgagagaggagttcatataatatatctggtggctgcacggccctcattgtgatttgccttttggggaagctgtatgttgcaaatgctggggatagcagggccataatcatcagaaatggagaaattatccccatgtcttcagaatttacccccgagacggagcgccagcgacttcagtacctggcattcatgcagcctcacttgctgggaaatgagttcacacatttggagtttccaaggagagtacagagaaaggagcttggaaagaagatgctctacagggactttaatatgacaggctgggcatacaaaaccattgaggatgaggacttgaagttcccccttatatatggagaaggcaagaaggcccgggtaatggcaactattggagtgaccaggggacttggggaccatgacctgaaggtgcatgactccaacatctacattaaaccattcctgtcttcagctccagaggtaagaatctacgatctttcaaaatatgatcatggatcagatgatgtgctgatcttggccactgatggactctgggacgttttatcaaatgaagaagtagcagaagcaatcactcagtttcttcctaactgtgatccagatgatcctcacaggtacacactggcagctcaggacctggtgatgcgtgcccggggtgtgctgaaggacagaggatggcggatatctaatgaccgactgggctcaggagacgacatttctgtatatgtcattcctttaatacatggaaacaagctgtcatgaaaatggcccaggggattgggaggacagaggggaagaaagctgggatgcctcttggcaggacggaactgggaagtgccccagctgagttccaagtgatgcagtctcttcccagcccaagcggggagttcatggccaaaagactatgcttcaagatgaccctttggtttccatttcttctttagtaacaggtcaactcaacaagagcaaaacacaaaggctgctaccaagtgttgttgtatttcagttcctttcataggcctccgaggtggccattgactatttggggtatatatgtcatatttattttatctagagtagctggggcagccattttcaggtgtaaatggcagaggactcttcagcctgtcaagctgccagcttatctacgggttaaaaagtgctgcattggaaagtagggggtcatgcctcaaaatgtaagtaagtgcccaccttctaggaagcctgaggtttatttcagggattgccgtctgccccccgccccccttctctttttttcttctctgtttctattcttttatggcagtggtggagtgaggcagggatttttttttttttttttcgtgtttttgacattccttgaatctgttttttattccccttccacagaacaggcctgggactttccaacaccctgctaaggaagttctgtgtccaagtcccacccaggctgggttgtccccacctcctccagcccacacagcccaggcagcatccgggccagtgccctgcatgacagagggtctttgttgtgtaatgtttgttcccaagttgcattttctaaccgaatcagtgtgttttcatgaaactgagtgtttctgtggaccagtagttcctctgttgtcttcagtggtcttcctgtgtggctcaagggttctctgtgagagtctggattttcatttctggaatggctggccccatcccacttttctgtatcatggggacacatataaagcagtgtttaatagagcagtttaagaagttgcttgcatctgttggttcaccatggctcatctggggaccattttggattcatgtttcatggcttgtgactgtccccaagcccactccaaacaaagtgtaaggatcagagttctgtcaaggagcagcagttctgctctccccatcatctttgtgcaaggcccctcggggggcactttaataaaagaatttgaaatgggttgactggccattctcatgctgtgctccctgtctcttctcttctctaaagaatcatgtcccagctcctcaaggtccctctatggttccacatctgagtgttcgccacaagagcagcagcagcaggcacagtgcatgccatatctacctgctgcttctctgctgggaggaatggccaagtagattataaaactcacttctgtctcttaggcagacttgtacggccacaaaattacctagtcttcttcctgctgagctactgaggtattgccaccattttgacaactttgagtaattaaaacactcttctgacccaaaaaggaaaaaaggtcactgacgtgacccccccagcatgctagagagctaattccagttctcatatttgtttgaatttcttcccagaggagaggataggaacctctcctccagggcagtaaatcacctgcatttctggagttgtcggtattgtattcgaaaaggcctggagcccctcctgctcaggaaagaactcattccagggtgtggagacagtgccgtctggcaggtgaaatactgtgggaattcacgccaccaggtgtttgtgcaagtgttggcctgggaagaatgggacttcggccttgtcaggagttgtcttcatctgcagcacgtttcttcctcctgcagtagatcttagctaccccagatatctctatggagagaagtttgtggaaaatgctttgcttcgtggcagagtctgatgctgtaggaaaaccttcgggcatgtgacagcagtgtggtccactccctgttctgccctggcactcagagtcatgtgtaagtaggaaacctgagcaagtcttccgtggaggaccctgagctgccgtctttgggatccttcctgtgtccccaccgtctttcatttatttgctttcctgggcctctatctgggccctaccttgagcttctccagttttattcaagccaccagagtaagaatttgggtgtagatgtcacaactaccttctactcaattcaccaattcatttactgctatggcacgtctcaggaataactctagaaacctctaaatcgaaatattataaaatcttgagcacttagtcctgctggttttagttagaaaggcatccaggaattgttttcctacgcccccttgagtggaaagatcttagttagaagataaagtcaagtttgtgttcaggggatgggaggaagactataaataagatgaagaaatcaaaagtaggaaacatgatgtaaacgaagcatggcagatctgtccagcactgatattgctctataaattgagcttactcagttttggccttatttttttacccaggccccatgtcacccagtcctaaaacagtaaccgtgtctacataacgggttggcccctggtgcatccctggaaaagtcaaaggacgcacacttcgaaattctgcagaacgtatttatacatggttcagaaatcttgcgtatctgacttatagccaaatctgcttgctcgaatagcctcagaggaagtcttgtttaataaaaaccttttgatttcctagtcaagtctttatggttgtctcgaggggtgtgtggctactttaatgaaaggctttcctgctctaaatctctttgctgggctgggcctcttcagactatctggtgaaactcctttccttagaacaaactcagtccgtccatgctctgtggcattttgctagatgataaccaaagccttattcctgtagccagtgtcagcagtcagagaggtggagggtgtgttctgctgtggttatgcatacctatctgctgttcttgaggtgtaaaaggaaaggtgaaaatcgggccaggccaagtactcagctgtcttaataggatgaagccttaagcagtggaaatttcagttattttccacagtattccattttggaggatttggggtgtttactttttaaattcttgaacaacttaacctccatgaggctttgtgaagtcagctgtgaccaccctcctcttactgtgttctcagtattcattcacttccagggaagaatgacagccacagggagatggtggtgggcaagaatgagagtcccaggatccagatttagcctcagatcttccccattcaggaagggttttccatttaacaagagcactagtatgaaaacattagggacaaatctcccatgtctttgaaattcggattctcctcttgagatccccttcctcacctgccaatcaactttataaggccacaagtggtcactggttttccttccacaggtttgaggttctcagctttccttaagcgacccagcagctccgctgttttcagagtgaatatgttaagctttgatgagattctattttcagtaagttagtgcttctgggacacttggagaaagctgtgagagtcattgtctacgcaaagaacaacgaagctgatcctaaaagtgatccaatctaagaaaatggtaaaacgagctctggccacagcacagaattttatgtgaggaactcagatttttgaagacttaacaattgcagagaaaggttgcagcctgcacaccatagcccacctctctgagcagactttggttttgtgtggtgacgtggcacatgtttgtacactgggatttttcaaaggacgctacgcgagcagactgacttgcctcttctgtgagcactgtggcttttgtcagatggagtgccggtctgcagaggactgctctttcgaatccacagtgttatctgtgtaaatagctttaatttttcttctgtgtcttaggtgaagttttgttcatgtagcaaccaggtagacagtgaccaaataaggctgtaaatgtgctgtagttttctactgtgatgtacttgaaggagaacctgtgtcctctacttttctgatctcccacaagtattttgtgtttgtttcctgagtcctgaggttattattttactcctgttttgcccccagttttctttgttttttttctggagacccagggaggcccatggtggagatcatttgtaaggaatggatcatggtctgggtttccaaaactaccctagtacagtgaatgagagaaatctgcctggaaattgtttcagaaccatgtacctttatgctttgtgattgtgaaacattgacttttttgtaaccccaaaatgaaaactgtttagtaaaggggatctattttgtgtgttttgaaacttaggtgcaatgtcccctggaaaaagctaaagaaatgtatatgttcaatgacattttaaaataaaatattatatatatgtatatacgacatattcagc

SEQ ID NO: 259 - DNA, 4465 bp, Homo sapiens
gtccgtcaggccgtgtgtcccaggccgtcgaccccgctgtcgcgctgcgtctgctccttgcatgcctttagatggtacagccttcagccggggcttcgggagacagtgcagccaccgagcatctctgctgagcttctccgccgatcctccttttctagcaggcagctcttctaggccacgtccaggtcgagggggaaaatggcgccggcgcccctaggcgtcccggaggagcagttgctggggtgtcgatctagagtgctttctcggttactcttcattgcccagaccgctctcctcctgttgcccgccgccggagcaggtctctgccccgcgccctgctcctgccgcattcctctcctggactgcagtcgcaggaaattgcccgcaccgagctggagggcgctgtcgggcttgctgccccccgacaccgctatcctggatttcagtcataatcggttgtctaactggaacatcagcttggaatcacaaacattacaggaagtgaaaatgaattacaatgaactaacagaaatcccgtattttggagaacctacatctaatattactctactttcattagtccataatataatcccagaaataaatgcacaggcactccagttttaccctgctctggagagtttagacctcagctcaaatataatatcagaaatcaagacatcttcatttcctcgcatgcagcttaaatacctgaatttaagtaataacagaataaccaccttggaggctggttgcttcgataatttatcaagttccttattagtggtaaagttaaaccgtaaccgaatgagcatgattccacctaagatcttcaagctgcctcacctccaattcttggaacttaaaagaaacagaattaaaattgtggaaggtcttacattccaagggcttgactccttaagatctttgaaaatgcagcggaatggaattagcaaacttaaggatggagcattttttggcttgaataacatggaagaactagaactggaacacaacaaccttacacgagtaaacaaggggtggttgtatggcttgcgaatgttacagcagctctatgtgagccagaatgctattgaaagaatcagccctgatgcatgggagttctgccaaagactatccgaacttgatttgtcctataaccagctgacccgcctggatgaatctgcctttgtgggtctgagcttattggagagattgaatttaggagacaacagagtcactcatattgctgatggtgtatttagatttctttccaatcttcagacattagacttaagaaacaatgaaatttcatgggccatagaagatgctagtgaagcctttgctggactcacaagtctcactaaactaatcttacaaggaaaccagattaagtcaattacaaagaaagcattcattggtcttgaatcccttgagcatctagatttgaacaataatgctataatgtctatccaagaaaatgctttttctcagactcatttaaaagaactgattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatgaaactcacttcaggatgaaatctgggcagagacttattaattaattttgcatttactacctcagagctcagaagaaactccgaagtcagcatttgctttactctttctttatgattgcatctgaccgcaccaaggtgggccatgcgttgtttggtcttatacctgatgaagaaatggcaacagctgacagaaatgggtacagctcatcaaaaatgtgcagcaccggcagagggaagatacggggcaaatgtgcttcctgatgcttccatggggatgtgccctggtgtgcatctgcttgtcaggaagagtcacattgctgcttaacatgctggattgccctagtcttcagaatggtcctgagaaaacatcactacttcgatgttctactttgctttccaaggagcaaaaataactttggagccttctgggaagtgtgcctgggattcttcagtggtttcaggcagatagttgagactggggctttgatattcaaggtctttggcaagaatcccaggcttgaccaactggtaccaggtcaaagatttttgtattcttgtgaatttttttttttgtccctattgcccagggatgtcattgtaaatatatgtgcatttataaataatttttgtattcattgaccatatgtgttggctgcaatgtaaatatttttgatatgccaaaattatatgtaatatccagttataatattgacaagtagcttctcagatcacagattttaaataactcaatttagtgagatctaaaaattttatttaaagtataaaaactgtggctcacacctgtaatcccagcattttgagaggctaaggtgggaggattgcttgaggccaggaatttgagaccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagt

SEQ ID NO: 260 - DNA, 8974 bp, Homo sapiens
cggacgcccggcgagtggcggaaagcgagaccccggcgccgagtgaggtcggccaggctgctgccgacttccccgctggcccctttgttcccctcccggggccctgccggcggcggttcccggttgcccgcgccagagcctcaggccggctccttttgcccttgagaagggttcgctgccaggccttcgagttccgggcgcagctcccgggagagccggcgccctgcctggcccggcggcctcctctcgggcacgaaggcttgctgctgcttctccagaacttcccttcctcgtagacacagcaaagagacttttaaaaaaccatggcagatgtggacccagatacattgctggaatggctacagatgggacagggagatgaaagggacatgcaactaatagcccttgaacagctatgcatgctgcttttgatgtctgacaacgtggatcgttgttttgaaacatgtcctcctcgcactttcttaccagccctttgcaaaatttttcttgatgaaagtgctccagacaatgtattagaggtgacagcccgtgccataacatactacctggatgtatctgcggaatgtacccgaaggattgttggggtagatggagctataaaagcactttgtaatcgtttggttgtagttgaacttaacaacaggactagcagagacttagctgaacagtgtgtaaaggtattagaactgatatgtactcgtgagtcaggagcagtctttgaggctggtggtttgaattgtgtgcttaccttcattcgtgacagtggacatctagttcataaagacaccttgcactctgctatggctgtggtatcaagactctgtggcaaaatggagcctcaagattcttctttagaaatttgtgtagaatctctgtctagtttattaaagcatgaagatcatcaggtttcagatggagctctgcgatgctttgcatcactggctgaccgatttacccgtcgtggtgttgacccagctccattagccaagcatggattaactgaggagctgttatctcgaatggctgctgctggtggtactgtttcaggaccatcatcagcatgcaaaccaggtcgcagcaccacaggagctccatccaccactgcagattccaaattgagtaatcaggtgtcaacaattgtaagtctgctctcaacactttgcagaggctctccggtagtaacacatgatcttctgaggtcggagcttccagattcaattgaaagtgcattgcagggtgatgaaagatgtgtgcttgatactatgcgtttggttgaccttctcttggtgctattatttgaaggacgaaaagctttgccaaagtctagtgctggatctacaggcagaatcccaggactccggagattagatagttctggggagcgctcacatcggcagcttatagattgtattcgaagtaaagataccgatgcacttatagatgcaattgacacaggagcctttgaagtaaattttatggatgatgtaggtcagactctattaaactgggcctctgcttttggaactcaggaaatggtagaatttctttgtgagagaggtgcagatgttaatagaggtcaaaggtcatcatcattacattatgctgcatgttttggaagacctcaagtagcaaagactctgttacggcatggtgcaaatccagatctgagagatgaagatgggaaaactccattagataaagctcgagaaaggggccatagtgaagtggtagctattcttcagtctccaggtgattggatgtgtccagttaataaaggagatgataagaaaaaaaaagatacaaacaaagatgaagaagaatgtaatgagcccaaaggagatccggaaatggcacccatatacttgaaaaggttattgccagtgtttgcacaaacatttcagcaaactatgctgccttcaataaggaaagcaagtcttgctctaattcgaaaaatgattcatttttgctctgaagcactgttacaagaagtttgtgattctgatgttggtcacaatttgcctacaatactagtggaaatcactgcaactgtccttgatcaagaggatgatgatgatggccacttgctagctttgcagatcataagggatatagtagataaaggtggtgatatatacaagcatcagctagccagacttggtgtaataagcaaagtgtcaacgttggcaggtccttcctctgatgatgagaatgaagaggaatcaaaaccagaaaaagaagatgaaccacaggaagatgctcaagaattgcaacaaggtaaaccatatcattggagagactggtcaatcattaggggaagggactgcttatatatttggagtgatgcagcagccttggaattatctaatggcagtaatggatggttcagatttatcttggatggaaaacttgccaccatgtattcaagtggtagtccggaaggtggatctgacagttcagaaagccgaagtgaattcttagagaagttacaaagagctcgaggccaagtaaagccatctacttcaagtcaacctatactgtcagcaccaggacccactaaacttactgtaggaaattggtcactgacatgtttgaaagaaggagaaattgctattcataattcagatggtcagcaagctacaatattgaaagaagatttacctggttttgtatttgaatctaatagaggaaccaaacattcatttactgcagaaacttccctgggttcagaatttgtgactggctggactggcaaaagaggcagaaaactgaaatctaagttagaaaaaacaaagcaaaaggtacgaactatggctcgagatttatacgatgaccattttaaagctgttgaaagcatgcctcgtggagtagtggtgacactcagaaacatagcaactcagttagagtcatcttgggaacttcatacaaatagacaatgtattgaaagtgagaacacttggagagatttaatgaagacagctttaaaaaacctaattgtacttttgaaggatgaaaacacaatttcaccatatgaaatgtgtagcagtggcttggtacaagcacttcttactgtgttaaacaatgtaagtatatttagggctacaaagcaaaaacagaatgaagtcccaaaggtgattttaagtgttttcaagactgcattcactgaaaatgaagatgacgaaagtcgaccagcagttgcgttaattcgaaagttaatagctgtactagaatctattgaacgtctacctctccatttgtatgatacaccaggatccacatataacctccagatacttacaaggagattacgatttcggttggaacgtgcacctggtgaaactgcattgattgacaggactggcagaatgttgaagatggaacctttggctacagttgaatctctggaacagtaccttttgaaaatggtagcaaaacagtggtatgattttgaccgatcttcatttgtttttgttcgaaaattaagagaaggacaaaattttatatttcggcaccagcatgattttgatgaaaatggaatcatttactggattggaacaaatgcaaaaactgcttatgaatgggtaaatccagctgcctatggacttgtagtagtaacgtcatcagaaggaagaaatctaccttatggccgcttagaagacatactaagtcgtgataattcagctttaaattgtcatagcaatgatgataagaatgcctggtttgccatagatctgggtctctgggtgataccatcagcatatacacttcgtcatgctcgtggttatggaaggtctgcactgagaaattgggttttccaggtatccaaagatggacagaactggacttctttgtatacccatgttgatgactgcagtctcaatgaaccagggtcaactgcaacttggcctcttgatccaccaaaggatgagaaacaagggtggagacatgtgagaattaaacagatggggaaaaatgccagtggacaaacacactacctctcattatctggattcgaactttatggcactgtaaatggagtatgtgaagatcagctagggaaagcagctaaagaagcagaagctaatcttagacggcagagacgtctagtacgttcccaggttctgaaatacatggttccaggagctcgtgttatcagaggcctggattggaaatggcgagatcaggatggcagcccacagggagaaggcactgtcacaggagaactacacaatggctggattgatgtcacctgggatgctggtggctcaaactcttaccgtatgggcgcagaaggaaaatttgacctcaagcttgcaccagggtacgaccctgatacagtggcatcacccaaacctgtttcatccactgtttcaggcacaacgcaatcatggagcagcttggtgaaaaacaactgtccagacaagacatctgctgctgcaggctcctcaagtagaaaaggaagcagcagttctgtgtgtagcgtggccagtagcagcgacatcagcttgggttcgaccaaaacggaacggagatcagaaattgtaatggaacacagtatagtttcaggagctgatgtccatgaaccaattgttgttctttcatctgctgaaaacgtccctcaaacagaagtagggtcatcttccagtgcaagcaccagcaccttaacagcggaaacgggaagtgaaaatgctgaaaggaagttaggccctgatagttctgttcgtactcctggggagtctagtgcaatatccatgggaattgtcagtgttagttctcctgatgttagttcagtatctgaattaactaataaagaagcagcttcacaacgacctcttagctcttcagcaagtaacagactgtcagtgagttctttgttggctgctggggcccctatgagctctagtgcaagtgtacctaacctgtcctcaagagaaacatctagcttggagagttttgtaaggagagtggcaaacatagcacggactaatgccacgaacaacatgaatctaagccgaagcagcagtgataacaacactaatactttggggaggaatgtgatgagcacagcaacttctcctcttatgggtgctcagagtttccctaatttgaccacacctggtactacatcaacagtgactatgtcaacatccagtgttactagcagcagcaatgtagctacagcaacaacagttttatcagttggtcaatctttaagtaacactttaaccaccagcctcacatcaacttccagtgagagtgacacaggtcaggaagcagaatattccttatatgatttccttgatagctgccgtgccagtactctattggctgagctcgatgatgatgaggacttacctgagccagatgaagaagatgatgagaatgaagatgacaatcaggaggaccaagaatacgaggaggttatgattctgagacgcccatccctgcaacgtcgagctggctcccgctctgatgtaacgcatcatgctgttacctcgcagctaccacaggtacctgctggagcagggagccgacctattggggagcaggaagaagaagagtacgaaactaaaggaggacgccggagaacatgggatgatgattatgtgctaaagagacagttttctgcattggttcctgcttttgatcctagacctggtcgtactaatgtccagcagacaactgatctagaaataccacccccagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacaatcatgtacagagaaatgaaggattctgataaagaaaaggaaaatggaaaaatgggttgctggtctatagagcatgtggagcagtaccttggcactgatgaattaccaaagaatgacttgataacctacctgcagaagaatgcagacgctgctttcctgcgccactggaaattaactggcactaataaaagtattaggaaaaacagaaattgttctcagctcatagctgcatataaggatttttgtgagcatggaacaaagtctgggttaaaccagggggccatttctactcttcaaagtagtgatattcttaatttaacaaaagaacaacctcaggccaaagcaggcaatggacagaactcttgtggagtagaagatgtccttcagcttctgcgtattctatatatagttgcaagtgacccttattcaagaatatcccaggaagatggtgatgaacagcttcagtttacttttccaccagatgaattcactagcaaaaaaattacaacaaaaatattacagcagattgaggaaccattggcactggcaagtggggctctgccagactggtgtgaacaattaaccagcaaatgtccttttctaataccatttgaaactagacagctttatttcacatgtacagcatttggcgcctcaagagcaatagtatggttacagaaccgacgtgaagccactgtggagcgaacgagaaccacaagcagtgttaggcgagatgaccctggagagtttcgagttggtcgtctcaagcatgaaagagtaaaagttccacgtggcgagtcactgatggaatgggctgagaatgtcatgcaaatacatgcagatcggaaatcagttcttgaggttgaatttttaggagaagaaggaactggcttgggacccacattagagttttatgctctggtggcagcagaattccagagaactgacttgggagcttggctttgtgatgataattttccagatgatgaatctcgtcacgttgatcttggaggtggattgaaacctcctggatattatgtgcagaggtcatgtggactgttcacagcaccatttccacaggatagtgatgagcttgaaaggatcacgaaactgtttcatttccttggaattttcttggccaaatgcattcaagacaatagacttgtggacttacctatttctaaacctttttttaaacttatgtgtatgggtgacattaaaagcaatatgagtaaactgatttatgagtcacgaggtgatagagacttacactgtactgaaagtcagtctgaagcttctacagaagaaggtcatgattcactctcggtaggaagctttgaagaggattcaaaatcagaatttattcttgatccccctaaaccaaaacccccagcttggtttaatggaattttgacttgggaagactttgaattagtaaacccacacagagccagatttttaaaagaaattaaagaccttgctatcaagaggcgccaaattttaagcaacaaaggtctttctgaagatgagaagaacacaaaattacaggaactagtgctgaagaatccatcaggttctgggcctccacttagcatagaggatttaggtttaaatttccagttttgcccttcctcaagaatatatggttttacagctgtggatctcaagccaagtggtgaagatgagatgataacaatggataatgcagaagaatatgtggatttgatgtttgacttttgtatgcatacgggtattcagaaacaaatggaagcctttagagatgggtttaataaagtttttccaatggagaaattaagttccttcagccatgaagaagtccaaatgattctttgtggaaaccagtcaccatcctgggcagcagaggatattatcaattacactgaacctaagctgggttatacacgtgacagccctggtttcctgaggtttgtgagggttttatgtggcatgtcttctgatgaaaggaaagcattcttgcagtttaccactggttgttcaactctacccccaggtggactggctaacctgcatcccaggctcacggttgtacgcaaggttgatgctactgatgcaagctatccatcagtcaatacatgtgtgcattaccttaagttgcctgaatattcttccgaggagatcatgagagagcgcctgctagctgctacaatggagaaaggctttcatctcaattgagctttgaagtgcaatgggagacatcagagactttaaaaatactagtgaagcctcttgtgtttgtgtgcagagaagtatatgatccaccatgctaatgacacttgcctttttttccaccattaaggctttaagaacatgtggaataagttttttagctgctaatgacaaaacaaatcctgtaactacccagccagcaagtatatagcacagaacactgtgttactttacaagggcttatgtgactggaataaggtggtcccacttgactgttccaaagagcagcttctcagatcttcagtgttcactggtaaatttctaacagtgtatttgtgtaaagtttgtcatttcatactccatacactacagttgctgtcactgatccctgttttgctggcttttaagctacttggtcaaaaatcctgcttccttaaaacatagagaattaatgagcatctcaagctttttcttttcctttttaatgatgcctgcactatcaagagtattctagtgttctctctttgtttggcatataatcatgcaccaaactttttatttctttaaggtgggagtatatttttatttcctaaatgccatactatgaagatcaaagtcttaagtgtgtttgcagctcaaaaataaagatgtattaaggggggaaaacctggtctaagtgcaaggcacacttacagcgagttttactttcggttgtattttctttgtatattataaacatttatttaacttgttgccgtttgaagtaaaaaatttccaaaatgtatgctcaacaataatcattaaaatgtttgcagcgt

SEQ ID NO: 261 - DNA, 4382 bp, Homo sapiens
gaattccgatggcagaagagaatccacctgcaattcctggctggcggttggcatctaagcaggcatcaggatgttgggctgggtccagagggtgctgcctcagcccccagggacccctcggaagaccaagatgcaggaggaagaggaagtggaaccagagccagagatggaggcggaggtggaaccagaaccgaatcctgaggaggccgagacagagtccgagtccatgccccccgaagagtcattcaaggaggaggaagtggctgtggcagacccaagccctcaggagaccaaggaggctgcccttacttccaccatatccctccgggcccagggcgctgagatttctgaaatgaatagtcccagccacagggtactgacctggctcatgaagggtgtagagaaggtgatcccgcagcctgttcacagcatcacggaggacccggctcagatcctggggcatggcagcactggggacacagggtgcacagatgaacccaatgaggcccttgaggcccaagacactaggcctgggctgcggctgcttctgtggctggagcagaatctggaaagagtgcttcctcagccccccaaatcctctgaggtctggagagatgagcctgcagttgctacagcgcctccaggacgcccccaggaaatggggcccaagctgcaggcccgggagaccccctccctgcccacacccatccccctgcagcccaaggaggaacccaaggaggcaccagctccagagccccagcccggctcccaggcccagacctcctccctgccaccaaccagggaccctgccaggctggtggcatgggtcctgcacaggctggagatggccttgccgcagccagtgctacatgggaaaataggggaacaggagcctgactcccctgggatatgtgatgtgcagaccatcagcatccttcctggaggacaagtggagcctgaccttgtcctagaggaggttgaaccgccctgggaggatgcccaccaggatgtcagtaccagcccacagggtacagaggtggttccagcttatgaagaagagaacaaagctgtggagaagatgcccagagagctgtcccggattgaagaggagaaagaagatgaggaggaggaagaggaagaggaggaggaggaggaagaggaggaggtgactgaggtgctgctggatagctgtgtggtgtcgcaggtgggcgtgggccagagtgaagaagacgggacccggccccagagcacttcagatcagaagctgtgggaggaagttggggaggaggccaagaaggaggctgaagagaaggccaaggaggaggccgaggaggtggctgaagaggaggctgaaaaggagccccaggactgggcggagaccaaggaggagcctgaggctgaggccgaggctgccagttcaggagtgcctgccacgaaacagcacccagaagtgcaggtggaagatactgatgctgatagctgccccctcatggcagaagagaatccaccctcaaccgtgttgccgccaccatctcctgccaaatcagacacccttatagtcccaagctcagcctcggggacacacaggaagaagctgccctctgaggatgatgaggctgaagagctcaaggcgttgtcaccagcagagtccccagtggttgcctggtctgaccccaccaccccgaaggacactgatggccaggaccgtgcggcctccacggccagcacaaatagcgccatcatcaacgaccggctccaggagctggtgaagctcttcaaggagcggacagagaaagtgaaggagaaactcattgaccctgacgtcacctctgatgaggagagccccaagccctccccagccaagaaagccccagagccagctccagacacaaagcccgctgaagccgagccagtggaagaggagcactattgcgacatgctctgctgcaagttcaaacaccgcccctggaagaagtaccagtttccccagagcattgacccgctgaccaacctgatgtatgtcctatggctgttcttcgtggtgatggcctggaattggaactgttggctgattcccgtgcgctgggccttcccctaccagaccccggacaacatccaccactggctgctgatggattacctatgcgacctcatctacttcctggacatcaccgtgttccagacacgcctgcagtttgtcagaggcggggacatcattacggacaaaaaggacatgcgaaataactacctgaagtctcgccgcttcaagatggacctgctcagcctcctgcccttggattttctctatttgaaagtcggtgtgaaccccctcctccgcctgccccgctgtttaaagtacatggccttcttcgagtttaacagccgcctggaatccatcctcagcaaagcctacgtgtacagggtcatcaggaccacagcctaccttctctacagcctgcatttgaattcctgtctttattactgggcatcggcctatcagggcctcggctccactcactgggtttacgatggcgtgggaaacagttatattcgctgttactactttgctgtgaagaccctcatcaccatcggggggctgcctgaccccaagacactctttgaaattgtcttccagctgctgaattatttcacgggcgtctttgctttctctgtgatgatcggacagatgagagatgtggtaggggccgccaccgcgggacagacctactaccgcagctgcatggacagcacggtgaagtacatgaatttctacaagatccccaagtccgtgcagaaccgcgtcaagacctggtacgagtacacctggcactcgcaaggcatgctggatgagtcagagctgatggtgcagcttccagacaagatgcggctggacctcgccatcgacgtgaactacaacatcgttagcaaagtcgcactctttcagggctgtgaccggcagatgatctttgacatgctgaagaggcttcgctctgttgtctacctgcccaacgactatgtgtgcaagaagggggagatcggccgtgagatgtacatcatccaggcagggcaagtgcaggtcttgggcggccctgatgggaaatctgtgctggtgacgctgaaagctggatctgtgtttggagaaataagcttgctggctgttgggggcgggaaccggcgcacggccaacgtggtggcgcacgggtttaccaacctcttcatcctggataagaaggacctgaatgagattttggtgcattatcctgagtctcagaagttactccggaagaaagccaggcgcatgctgagaagcaacaataagcccaaggaggagaagagcgtgctgatccttccaccccgggcgggcaccccaaagctcttcaacgctgccctcgctatgacaggaaagatgggtggcaagggggcaaaaggcggcaaacttgctcacctccgggcccggctcaaagaactggccgcgctggaggcggctgcaaagcagcaagagttggtggaacaggccaagagctcgcaagacgtcaagggagaggaaggctccgccgccccagaccagcacacgcacccaaaggaggccgccaccgacccacccgcgccccggacgccccccgagcccccggggtctccaccgagctctccaccgcctgcctcccttgggaggccggagggagaggaggaggggccggccgagcccgaagagcactcggtgaggatctgcatgagcccgggcccggagccgggagagcagatcctgtcggtgaagatgccggaggaaagggaggagaaggcggagtaaggtggggtgaggcggatcccgcgcgcagttccagcaggtgtgtccccagcgcccgctgcgcccctcgccccagcgccccaccttcccccacggctcaagagaagatgcttttccgtagtcgtgacctcagtggctgcagctctgaccgtcccgccagcacgccagccccgactcagctcctcgcggggctgggcctgagctcgacaagttgcatcaagtgttcgagtccctgagctctcactatcatttgagagccctaccttttcctgactgttcctctttttaagaacaaaatgattttccacttttaaagttcatgggtgagggataaaatgaggctccaatacatgggaagctttgctgaaaaagtaaagtgttattgaatgtgtggggtttcccctcaggaatttgtctaacacatttcaaggatagaaaatacttcactgccgggcatggtggctcatgcctataatcccagtgctttgggaagccgaagcaggaggatcactggaggccaagagttggagagcagactgggcaacatagcgagacctcatctcaaaccggaattcgg

SEQ ID NO: 262 - DNA, 1276 bp, Homo sapiens
tgagatcacttcccttgcacagtttggaagggagagcactttattacagaccttggaagcaagaggattgcattcagcctagttcctggttgctggccaaagggatcatggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatcaaatactttcatccataaaaatgtcagcatttattaaaaaacaataactttttaaagaaacataaggacacattttcaaattaataaaaataaaggcattttaaggatggcctgtgattatcttgggaagcagagtgattcatgctagaaaacatttaatattgatttattgttgaattc

SEQ ID NO: 263 - DNA, 1535 bp, Homo sapiens
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 264 - DNA, 3512 bp, Homo sapiens
gacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagagagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagccacaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaag

SEQ ID NO: 265 - DNA, 3186 bp, Homo sapiens
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgccccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcaatgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctctagtagccctcagtgtcgaaggtgagcttgtaggtgcctgccttcatctggtccaggacagtgaccatctgggtctgtgtagctggggagagaatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgtttt

SEQ ID NO: 266 - DNA, 3094 bp, Homo sapiens
gtctcggccatgacacacatttgacatgccctccctcaacctacttatagactatttttcttgctctgcagcatggaccaaagagaaattctgcagaagttcctggatgaggcccaaagcaagaaaattactaaagaggagtttgccaatgaatttctgaagctgaaaaggcaatctaccaagtacaaggcagacaaaacctatcctacaactgtggctgagaagcccaagaatatcaagaaaaacagatataaggatattttgccctatgattatagccgggtagaactatccctgataacctctgatgaggattccagctacatcaatgccaacttcattaagggagtttatggacccaaggcttatattgccacccagggtcctttatctacaaccctcctggacttctggaggatgatttgggaatatagtgtccttatcattggtatggcatgcatggagtatgaaatgggaaagaaaaagtgtgagcgctactgggctgagccagtagagatgcagctggaatttggccctttctctgtatcctgtgaagctgaaaaaaggaaatctgattatataatcaggactctaaaagttaagttcaatagtgaaactcgaactatctaccagtttcattacaagaattggccagaccatgatgtaccttcatctatagaccctattcttgagctcatctgggatgtacgttgttaccaagaggatgacagtgttcccatatgcattcactgcagtgctggctgtggaaggactggtgttatttgtgctattgattatacatggatgttgctaaaagatgggataattcctgagaacttcagtgttttcagtttgatccgggaaatgcggacacagaggccttcattagttcaaacgcaggaacaatatgaactggtctacaatgctgtattagaactatttaagagacagatggatgttatcagagataaacattctggaacagagagtcaagcaaagcattgtattcctgagaaaaatcacactctccaagcagactcttattctcctaatttaccaaaaagtaccacaaaagcagcaaaaatgatgaaccaacaaaggacaaaaatggaaatcaaagaatcttcttcctttgactttaggacttctgaaataagtgcaaaagaagagctagttttgcaccctgctaaatcaagcacttcttttgactttctggagctaaattacagttttgacaaaaatgctgacacaaccatgaaatggcagacaaaggcatttccaatagttggggagcctcttcagaagcatcaaagtttggatttgggctctcctttgtttgagggatgttctaattctaaacctgtaaatgcagcaggaagatattttaattcaaaggtgccaataacacggaccaaatcaactccttttgaattgatacagcagagagaaaccaaggaggtggacagcaaggaaaacttttcttatttggaatctcaaccacatgattcttgttttgtagagatgcaggctcaaaaagtaatgcatgtttcttcagcagaactgaattattcactgccatatgactctaaacaccaaatacgtaatgcctctaatgtaaagcaccatgactctagtgctcttggtgtatattcttacatacctttagtggaaaatccttatttttcatcatggcctccaagtggtaccagttctaagatgtctcttgatttacctgagaagcaagatggaactgtttttccttcttctctgttgccaacatcctctacatccctcttctcttattacaattcacatgattctttatcactgaattctccaaccaatatttcctcactattgaaccaggagtcagctgtactagcaactgctccaaggatagatgatgaaatcccccctccacttcctgtatggacacctgaatcatttattgtggttgaggaagctggagaattctcaccaaatgttcccaaatccttatcctcagctgtgaaggtaaaaattggaacatcactggaatggggtggaacatctgaaccaaagaaatttgatgactctgtgatacttagaccaagcaagagtgtaaaactccgaagtcctaaatcagaactacatcaagatcgttcttctcccccacctcctctcccagaaagaactctagagtccttctttcttgccgatgaagattgtatgcaggcccaatctatagaaacatattctactagctatcctgacaccatggaaaattcaacatcttcaaaacagacactgaagacttctggaaaaagtttcacaaggagtaagagtttgaaaattttgcgaaacatgaaaaagagtatctgtaattcttgcccaccaaacaagcctgcagaatctgttcagtcaaataactccagctcatttctgaattttggttttgcaaaccgtttttcaaaacccaaaggaccaaggaatccaccaccaacttggaatatttaataaaactccagatttataataatatgggctgcaagtacacctgcaaataaaactactagaatactgctagttaaaataagtgctctatatgcataatatcaaatatgaagatatgctaatgtgttaatagcttttaaaagaaaagcaaaatgccaataagtgccagttttgcattttcatatcatttgcattgagttgaaaactgcaaataaaagtttgtcacttgagcttatgtacagaatgctatatgagaaacacttttagaatggatttatttttcatttttgccagttatttttattgtcttttacttttctacataaacataaacttcaaaaggtttgtaagatttggatctcaactaatttctacattgccagaatatactataaaaagttaaaaaaaaaaacttactttgtgggttgcaatacaaactgctcttgacaatgactattccctgacagttatttttgcctaaatggagtataccttgtaaatcttcccaaatgttgtggaaaactggaatattaagaaaatgagaaattatatttattagaataaaatgtgcaaataatgacaattatttgaatgtaacaag

SEQ ID NO: 267 - DNA, 5376 bp, Homo sapiens
agccggagctggagccgaggcggcggcgggacgcggccggccggacaaatttcctgctaggctgcggacagcgggcggcaggagccggcgcgagcggcttcaggaacccacggcctctgcgcgtccccgcgacccttcttcgcgcccggcgaagacagccgggcgccccggagggcggcgggcaggcgcccgggagatgcggagcctccgctgcagcgcgatctgcgcgaccagaccggcccccccgagactatagccttcactttccctcggtccaccatggagcccttgtgtccactcctgctggtgggttttagcttgccgctcgccagggctctcaggggcaacgagaccactgccgacagcaacgagacaaccacgacctcaggccctccggacccgggcgcctcccagccgctgctggcctggctgctactgccgctgctgctcctcctcctcgtgctccttctcgccgcctacttcttcaggttcaggaagcagaggaaagctgtggtcagcaccagcgacaagaagatgcccaacggaatcttggaggagcaagagcagcaaagggtgatgctgctcagcaggtcaccctcagggcccaagaagtattttcccatccccgtggagcacctggaggaggagatccgtatcagatccgccgacgactgcaagcagtttcgggaggagttcaactcattgccatctggacacatacaaggaacttttgaactggcaaataaagaagaaaacagagaaaaaaacagatatcccaacatccttcccaatgaccattctagggtgattctgagccaactggatggaattccctgttcagactacatcaatgcttcctacatagatggttacaaagagaagaataaattcatagcagctcaaggtcccaaacaggaaacggttaacgacttctggagaatggtctgggagcaaaagtctgcgaccatcgtcatgttaacaaacttgaaagaaaggaaagaggaaaagtgccatcagtactggcccgaccaaggctgctggacctatggaaacatccgggtgtgcgtggaggactgcgtggttttggtcgactacaccatccggaagttctgcatacagccacagctccccgacggctgcaaagcccccaggctggtctcacagctgcacttcaccagctggcccgacttcggagtgccttttacccccattgggatgctgaagttcctcaagaaagtaaagacgctcaaccccgtgcacgctgggcccatcgtggtccactgtagcgcgggcgtgggccggacgggcaccttcattgtgatcgatgccatgatggccatgatgcacgcggagcagaaggtggatgtgtttgaatttgtgtctcgaatccgtaatcagcgccctcagatggttcaaacggatatgcagtacacgttcatctaccaagccttactcgagtactacctctacggggacacagagctggacgtgtcctccctggagaagcacctgcagaccatgcacggcaccaccacccacttcgacaagatcgggctggaggaggagttcaggaaattgacaaatgtccggatcatgaaggagaacatgaggacgggcaacttgccggcaaacatgaagaaggccagggtcatccagatcatcccgtatgacttcaaccgagtgatcctttccatgaaaaggggtcaagaatacacagactacatcaacgcatccttcatagacggctaccgacagaaggactatttcatcgccacccaggggccactggcacacacggttgaggacttctggaggatgatctgggaatggaaatcccacactatcgtgatgctgacggaggtgcaggagagagagcaggataaatgctaccagtattggccaaccgagggctcagttactcatggagaaataacgattgagataaagaatgataccctttcagaagccatcagtatacgagactttctggtcactctcaatcagccccaggcccgccaggaggagcaggtccgagtagtgcgccagtttcacttccacggctggcctgagatcgggattcccgccgagggcaaaggcatgattgacctcatcgcagccgtgcagaagcagcagcagcagacaggcaaccaccccatcaccgtgcactgcagtgccggagctgggcgaacaggtacattcatagccctcagcaacattttggagcgagtaaaagccgagggacttttagatgtatttcaagctgtgaagagtttacgacttcagagaccacatatggtgcaaaccctggaacagtatgaattctgctacaaagtggtacaagattttattgatatattttctgattatgctaatttcaaatgaagattcctgccttaaaatattttttaatttaatggtcagtatattttgtaaaaatcatgttaatttatttcatagttgacattaatatcttccctaatttctttgtatatattttgttatgccttaaaggccacctgctatacagttgttaaatcttaaatatgctttttaaaaattggaataatgtattaaggtcaaataatatcccataaaatatatatttctgctaatattagtaaatatcttaatttttcattagattcatatcatttaatttcacatattcaacacctttaaatgttgtaatcttaatatgcgaagtgtgcctctgcaagatactaacacaaagctcatgttaagaaaacagttgaggactcagaagtcagttgaaaatgcactttcctaacagtgaattcacaaccctgaacagcagcatttttggaaggcaaactgttcgtgatggtacaatgtaaatggggacttctgtaaagttctcagtttcggtccatgtggtttatctttacattttaaagatcaaagaagtctttacaacctgaatccaggtctaaaacacactagagtagctggtgactataaataatattttaaaatgctgtgtctacaccatcaagactgtgtctacactatcttggctgaacgagaagagatgtaaatgctgggtggtcccgttgacccacggcgttgggtacaacaaaaccagccatcggagttacaccccaaagcaccatttgctgtccagctgcctgtcgtttggcccagaccaccctcagaaaaaaaccagctgcctctcccattctcccctcccgttctgccacagcggcctgggctggtccagtgctatgcctggaggctcaacacaaaacttcccatccaaacattcagatgaactgagcgtcttacacacgcagtacagaggagcacacattaggatagaaacagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagagaaatccttaatctaaaagctaaattatttttgaatggaaatactactgagaccattgacactggataacagtaatgatcccattaccagataagattgactgacggggaaaaaaaaaaaaaaagaatggggtgtgaatgtaccaacactgaatcttacagcagttatctttctatggccattaggtacctagcagatgtgcacaatataaacaaaaagatatctggcctaccttactactaaaagcatttaacacgtgcatttttggtacttttttttttgttttctaaaagctacataaaggccttatttgacattttcactgataactgatcgcaccctcatgttgcagtgttcgtcccctattcattaacagtgtgtgcaaatgcaaccccaggacacattattgttctgatagatgctcacagggaatcaagcttctcgcccactccacggctctgagccccatccaagggcaagacttggtgcccagctggaaggacgaaagcacactttgtgaccgccatcctcaccagctgcatgcctgggctgcacactgctgaacgtgctcctctctccttctctgtacaatgattcagcatctcggcggaagaggaaaatggagctttttgaggctcgccaggtcccttttgttttcaccattaaaattccaaacccaaagcctttgtttgactgaaggagaagagagggaagtaagcttctgttcagcacctgaaccctagaaaaagagccagtttgctacgatgaaggtgacatttctctggtcatttatttgagagttcgaagtcaaagtcgaggggcaccggctttggttcatgtctaggagccctctgtcagaatccttgaagccctttaatggtctaactggcatctcttgtatcaagaagtacctttaaggtagaccttttcagggtgccctcaggaaagggccctgctcatgtttttttcctgtccccttagaccaaccccaggtgtccactgcaggggttctgcctgttcccaaactttttccattccaggaacaaaggagaagccactttccccaggacgcaagactctcccctccactgtccgggacagcgttcgccctttagcggggaggtcattacagcctcatggcctctaccaaggccccagatcacaggatctcctgggccttggagcacctcacgctgggggaatcaatccctgagggactcagaatcttctccgtgcaacctggaaagttcatctcttgtttccttcagtcaaagaaagtccattgtacataacaaaacagcccccaaacagcccagtgccgacaccattgttcctttcacactttcctttgttgcatgcagttgggttcaaatgccaaatagtgattagaagacgaccattctgatctgtgtgtgatctggtcactatgtgactgcctttacggtttctctccatgtgctatatgaatgaagaatgcataccagtgttttaaaaggtatttttatgtgtttttaaacacttttttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacctttactttgactaccagcctgtgtttttgtctttaaatctcttaatttcattcctctgcaaa

SEQ ID NO: 268 - DNA, 1394 bp, Homo sapiens
gacatcgacctagtggtgtttgggaagtgggagaacctacccctctggactctggaagaagctcttcggaaacacaaagtcgcagatgaggattcggtgaaagttttagacaaagcaactgtacctattattaaattaacagattcttttactgaagtgaaagttgatatcagctttaatgtacagaatggcgtgagagcagctgacctcatcaaagattttaccaagaaatatcctgtattgccatacttggttttagtattgaaacaattcctattgcagagggaccttaatgaagtatttacaggtggaattggttcttatagtctctttttaatggcagtcagtttccttcagttacatcccagggaagatgcttgcatccccaatacaaactatggtgttctcttaatagaattttttgaattatatggacgacacttcaattatttaaagactggcatccggataaaggatggtggttcatatgtggccaaagatgaagtacagaaaaatatgctagatggctacaggccatcaatgctttatatcgaagatcctttacaaccaggtaacgatgttggaaggagttcatatggggccatgcaagtgaagcaggcctttgattatgcctacgttgttttgagtcatgctgtatcaccaatagcaaagtactatcccaacaatgaaacagaaagcatactaggtagaataattagagtaacagatgaagttgccacatatagagattggatatcaaagcagtggggcttgaagaatagacctgagccttcatgcaatggaaatgaaactcttcatcaggtccagtgtcgtcctcttctgccacacagtccagctctagtgacgtagattccgatgcaacaccatgcaaaaccctgaaacagctgctttgccgtccgtccactgggaaccgagtagggtcgcaagatgtatccttggagtcctctcaggcagttgggaaaatgcaaagcacccaaaccactaacacatccaacagcaccaacaaatctcagcatggatcagcaaggctctttcgttcttccagcaaaggcttccaaggtacaactcaaacaagccatggttccttgatgacaaacaaacaacatcaaggcaaatccaataatcagtattaccatggcaaaaagaggaaacacaagagggacgcgcccctctcagacctctgtagatagtcagcgctgcgcggtggactgtcttctctgtgcaatgatctcatgctcaggacagttgcgcagggactcctgggagatattcaggagcctcacactgttcagacgttgacttagcaactgcgttttttcccagctcgccacagaatggatcatgaagactgacaactgcaaaaaaaacaaaac

SEQ ID NO: 269 - DNA, 4160 bp, Homo sapiens
gcgcttgcggaggattgcgttgacgagactcttatttattgtcaccaacctgtggtggaatttgcagttgcacattggatctgattcgccccgccccgaatgacgcctgcccggaggcagtgaaagtacagccgcgccgccccaagtcagcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggctccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttgtcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaaaaaaaaaaaaaaaa

SEQ ID NO: 270 - DNA, 2276 bp, Homo sapiens
cctgtgtgctggggaggaatcccgcagtggccggggggcttgaggccgctgctttgtctcttcgtccagagccttatgtaagagcttttctcgggaaacaggaagtcctgcttgccaatttcagcacagggagtagtgcaggccttattccaacacacccggcccagccttaaccccagaactcagccagtttcttgcttccgtgcccctggttctcctccccatcgagcccacccctcctttcccaccttcagtcacccctagtgaactgccccagcgatctctgctgtgcttgaccccgagggtcttccaccctcgccctgaccctggacactgcccagcttggccccccatcctgctcctggcacaatgccctctagccagccaaccttccctcccccaaccctggggccgccccagggttcctgcgcactgcctgttcctcctgggtgtcactggcagccctgtccttcctagagggactggaacctaattctcctgaggctgagggagggtggagggtctcaaggcaacgctggccccacgacggagtgccaggagcactaacagtacccttagcttgctttcctcctccctcctttttattttcaagttcctttttatttctccttgcgtaacaaccttcttcccttctgcaccactgcccgtacccttacccgccccgccacctccttgctaccccactcttgaaaccacagctgttggcagggtccccagctcatgccagcctcatctcctttcttgctagcccccaaagggcctccaggcaacatggggggcccagtcagagagccggcactctcagttgccctctggttgagttggggggcagctctgggggccgtggcttgtgccatggctctgctgacccaacaaacagagctgcagagcctcaggagagaggtgagccggctgcaggggacaggaggcccctcccagaatggggaagggtatccctggcagagtctcccggagcagagttccgatgccctggaagcctgggagaatggggagagatcccggaaaaggagagcagtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgtgattgtgttataaaaagtggctcccagcttggaagaccagggtgggtacatactggagacagccaagagctgagtatataaaggagagggaatgtgcaggaacagaggcgtcttcctgggtttggctccccgttcctcacttttcccttttcattcccaccccctagactttgattttacggatatcttgcttctgttccccatggagctccgaattcttgcgtgtgtgtagatgaggggcgggggacgggcgccaggcattgtccagacctggtcggggcccactggaagcatccagaacagcaccaccatctagcggccgctcgagggaagcacccgccggttggccgaagtccacgaagccgccctctgctagggaaaacccctggttctccatgccacacctctctccaggtgccctctgcctcttcaccccacaagaagccttatcctacgtccttctctccatctatcggaccccagtttccatcactatctccagagatgtagctattatgcgcccgtctacagggggtgcccgacgatgacggtgccttcgcagtcaaattactcttcgggtcccaaggtttggctttcacgcgctccattgccccggcgtggcaggccattccaagcccttccgggctggaactggtgtcggaggagcctcgggtgtatcgtacgccctggtgttggtgttgcctcactcctctgagctcttctttctgatcaagccctgcttaaagttaaataaaatagaatgaatgataaaaaaaaaaaaaaa

SEQ ID NO: 271 - DNA, 3850 bp, Homo sapiens
agactgggtgcctgtggccctgggaggaggtggaaggggaggagcaggccacacaggcacaggccggtgagggacctgcccagacctggagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactacaaacccacaccagacctgcgcatctccatcgagaactccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggagcggggaggctgagaagagactcctcctggtggacttcagcagccaagccctgttccaggacaagaattccagccaagtcctgggtgagaaggtcttggggattgtggtacagaacaccaaagtagccaacctcacggagcccgtggtgctcactttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgaacctgctgctggccgtcttcctgctggacacgagcttcctgctcagcgagccggtggccctgacaggctctgaggctggctgccgagccagtgccatcttcctgcacttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagacagcgccaggctccccatcagctcgggcagcacctcgtccagccgcatctaggcctccagcccacctgcccatgtgatgaagcagagattcggcctcgtcgcacactgcctgtggcccccgagcccggcccagccccaggccagtcagccgcagactttggaaagcccaacgaccatggagagatgggccgttgccatggtggacggactcccgggctgggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggccaggccttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccaggagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccctcttgtggcaagaactgtggaccatgccagtcccgtctggtttccatcccaccactccaaggactgagactgacctcctctggtgacactggcctagggcctgacactctcctaagaggttctctccaagcccccaaatagctccaggcgccctcggccgcccatcatggttaattctgtccaacaaacacacacgggtagattgctggcctgttgtaggtggtagggacacagatgaccgacctggtcactcctcctgccaacattcagtctggtatgtgaggcgtgcgtgaagcaagaactcctggagctacagggacagggagccatcattcctgcctgggaatcctggaagacttcctgcaggagtcagcgttcaatcttgaccttgaagatgggaaggatgttctttttacgtaccaattcttttgtcttttgatattaaaaagaagtacatgttcattgtagagaatttggaaactgtagaagagaatcaagaagaaaaataaaaatcagctgttgtaatcacctagcaaactggaaaaaaaaaaaaaaaaaaaaaaaaaaaaaaaaaaaaaaaaaaaaaaaaaaaaaaaaaaaaaaaaaaaaaaaaaa

SEQ ID NO: 272 - DNA, 396 bp, Homo sapiens
atggagatgggcaaatggattcatttagagctgcggaacaggacgccctccgatgtgaaagaacttttcctggacaacagtcagtcaaatgaaggcaaattggaaggcctcacagatgaatttgaagaactggaattattaaatacaatcaacataggcctcacctcaattgcaaacttgccaaagttaaacaaacttaagaagcttgaactaagcagtaacagagcctcagtgggcctagaagtattggcagaaaagtgtccaaacctcatacatctaaatttaagtggcaacaaaattaaagacctcagcacaatagagcccctgaaaaagttagaaaacctcgagagcttagaccttttcacttgcgaggtaaccaacctgaacaactactga

SEQ ID NO: 273 - DNA, 8266 bp, Homo sapiens
gccatttttcctttctgaaggcaggtctcacctatctcctggttcgatctaggaaaaaggaaaggaagggatttaaaagtaaacagtgaaatgagaaagaattcactgggagtttatcaaactaagttaaaatagctaagtcagcctgacaggtgcttggcacagagaaggagcaaatatttcctcatgatgctacaacatttagtaattttttgtcttggattggttgtacaaaatttctgctccccagctgaaaccacagggcaggcaagaagatgtgataggaagtctcttcttacaattaggaccgagtgccgatcctgcgctctcaaccttggagtcaagtgcccggatggttacaccatgattaccagtggctctgtaggggttcgagattgcaggtacacctttgaggtcagaacatactctctgtctctccccggatgccgccatatttgtaggaaggactatctccaacctcggtgttgtcctggccgctggggcccagactgtatagagtgcccaggtggagcggggtcaccctgcaatggcagaggcagttgtgctgaaggcatggaaggaaatggaacctgctcctgccaagaagggtttggtggaacagcctgtgaaacctgtgctgacgacaacttatttggacccagctgttcatcagtgtgcaactgtgtgcatggggtgtgcaacagtggactagatggcgatggaacctgtgagtgctactctgcgtacactggccccaagtgtgacaagcccatccctgaatgtgcagccttgctctgcccagaaaattccagatgttcgccttccactgaagatgaaaacaaactggaatgcaaatgccttcccaattaccgaggcgatggcaaatactgcgaccccatcaatccatgtttacgaaaaatctgccaccctcatgctcattgtacgtacctgggaccaaatcggcacagttgtacatgccaagaaggctaccgtggggatggccaagtgtgcttgcctgtggacccctgccaaattaactttggaaactgccctacaaagtctacagtgtgcaaatatgatgggcctggacagtctcactgcgagtgtaaggagcattaccagaatttcgtacctggagtggggtgcagtatgactgatatatgtaaatcagataacccgtgtcataggaatgcaaattgcaccaccgtcgcaccaggccgaactgaatgcatttgccagaaaggttacgtgggtgatggcttaacgtgttatggaaacattatggagcgactcagagaattaaatactgaacccagaggaaaatggcaaggaaggctgacctctttcatctcactcctagacaaagcttatgcctggccactgagtaagctgggacccttcacggtgctgttacctacagacaagggactgaaaggattcaatgtaaatgagcttttggtggataataaagctgctcaatactttgtgaaactccacataattgctggtcagatgaacatcgaatatatgaataacacagacatgttctacaccttgactggaaagtcgggggaaatcttcaacagcgataaggacaatcaaataaagcttaaactccatggaggcaaaaagaaggtaaaaattatacaaggggacatcattgcttccaatgggcttctgcacatccttgacagagccatggacaagttagaacacacatttgagagcaacaatgagcaaaccataatgacaatgctacaaccaaggtacagcaagttcagatctttgttagaggaaaccaatttgggacatgccttagatgaggatggagttggtggaccatacaccatttttgttccaaataatgaagcattgaataacatgaaggacggcactctcgattacctcctttctccagagggatctcggaagcttctggaactcgtcagataccacattgtcccatttacccagcttgaagtggccactctcatctccacccctcacatcaggagcatggccaaccagctcatacagttcaacaccaccgacaatggacagattctggcaaatgatgtggcaatggaagaaattgagatcactgccaaaaatggccgaatttacacactgacaggagttctcattcctccctccattgtcccgattctgccccatcgatgtgatgaaacaaagagagagatgaaactgggcacttgtgtgagctgttctctggtgtactggagcagatgtcctgctaactctgagcccacagcactcttcacacacagatgtgtctacagtggcaggtttgggagcctgaagagcggctgtgcccggtactgcaatgccactgtgaagattccaaagtgctgcaaaggcttctatggacctgactgcaaccagtgtccaggaggcttctcaaatccatgctcaggaaatggacagtgtgcagatagcctcggcggcaacgggacatgcatttgtgaggagggcttccaaggctcccagtgtcagttctgctctgatcccaataaatacggacctcggtgtaacaaaaaatgcctgtgcgttcacggaacatgcaataacaggatagacagcgatggggcctgcctcactggcacatgcagagacggctctgccgggagactctgtgataagcagacctcagcctgtgggccctatgtgcagttctgtcacatccacgccacctgtgaatacagcaatgggacagccagttgtatttgcaaagcaggatatgaaggagatggaactctgtgttctgagatggacccttgcacaggactaactccaggaggctgtagccgcaatgcagaatgcatcaaaactggcacgggcacccacacctgcgtgtgtcagcagggttggacagggaatgggagagactgctcggagatcaacaactgcctgctgcccagtgcaggcggctgccacgacaacgcatcctgtttgtatgtgggtcccgggcagaatgagtgtgagtgcaagaaaggatttcgaggaaatgggattgactgtgaaccaataacttcatgcttggaacaaaccgggaaatgtcatccattggcaagctgtcaatctacttcgtctggtgtctggagctgtgtttgtcaagagggctatgaaggagatggctttctgtgctatggaaacgcagcagtggaattgtcatttctctccgaagcagctatatttaaccgatggataaataatgcttctctacaacccacactgtcagccacctcaaacctcactgtcctcgtgccttcccaacaagctactgaggacatggaccaggatgagaaaagcttctggttgtcacagagcaatattccagccctaataaagtaccatatgctactaggcacatacagagtggcagatctgcagaccctgtcttcttctgacatgttggcaacatctttgcagggcaacttccttcacttggcaaaggtggatgggaatatcacaattgaaggggcctccattgtcgatggggacaatgcagccacaaatggagtgatacacatcatcaacaaggtgctggtcccacaaagacgtctaactggctccttaccaaacctgctcatgcggctggaacagatgcctgactatcccatcttccggggctacatcattcaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgccactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgtccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaataataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagatttgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggccatcaactgtgaattctcagcaccagttgccttttaggaacgtaaagtcctttaagcactcagaagccatacctcatctctctggctgatctgggggttgtttctgtgggtgagaratgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaaaaaaaaaaaaaaaaaaaaaaaaaaaaaaaaaaaaaa

SEQ ID NO: 274 - DNA, 1507 bp, Homo sapiens
aaacagttgccttttcctctcacagaaggaagatttcattttgtttgagacgagaaaccaaaccacacaccaaagagaggggtatgatggctaagaagcccccaaaaccagcccctcgcaggatcttccaggaaaggttaaagattactgctctacctttgtactttgaaggttttttattaatcaagcggtcaggataccgggagtatgagcattactggacagagttgagaggaactactcttttcttttataccgacaaaaagagtataatatatgttgacaaattagacatagtagacctcacatgccttactgagcagaattcaactgaaaagaactgtgcgaaattcacccttgttttgccgaaagaggaagtacaactgaagacagagaacacagaaagtggggaagaatggagaggcttcattcttacagtaacagagctgtcagttccccaaaacgtgtcactcctacctgggcaagtaattaaactgcatgaagtcctagagagagaaaagaaaaggaggattgagacagagcagagtacgtccgtggaaaaagagaaggaaccaactgaagattatgtggatgtactgaaccctatgccagcatgtttttatacagtgtcccggaaagaggcaactgagatgctccagaagaacccttctttgggaaatatgatcctgaggcctggtagtgacagtagaaactactccatcactattcggcaggagatagacattccaagaatcaagcactacaaagtgatgagcgtaggacaaaactacactattgaactggaaaaacctgtaacactcccaaaccttttcagtgtcattgattattttgtgaaggagactcgaggaaatttaagaccatttatatgttcaactgatgaaaacactggtcaagaacccagtatggaagggagaagtgaaaagttgaagaaaaatccacacattgcatgaaatacaatgtgaaagctcctttgtatatcttggtaatttatattttcaaaacgaagttcttacttttaaagagaattacctatattctcctgatactgattaccaagtcattcacctgaacaccagaattagaattaaacattgtaccatacaatttcattatcttatcagaatgaaaccaattcacagggaaactagagactacggctgtggtggtaacctgcagatatacacattcccatgcactgacataagttgaaaacacatagtactttctagatggaatttttttctttaggcctcaatgaaatacatttcccctatataattccaacagcagtttctctagttctaaattttaccaattcccaaaaaacctaagttttgctgaaatctgatttgaccaatttatcaaatatgtcattttaattacctagctggaagttagagacatgaaatgtactagaggagcccttttccaatggaaatattatataccacattttttgttaatggaaataaatgtctccattccc

SEQ ID NO: 275 - DNA, 1451 bp, Homo sapiens
aggggcgctccggccagtgattggctggaggtttgttaactattcatgagggggcgggccgagcggggcggcctttgttaagcagcgagggcgcgaccgcgggtactctgctgccggcttctcggagcggcgctgggcgaccagagcagggtcgagatgtcctacatcccgggccagccggtcaccgccgtggtgcaaagagttgaaattcacaagctgcgtcaaggtgagaacttaatcctgggtttcagcattggaggtggaatcgaccaggacccttcccagaatcccttctctgaagacaagacggacaagggtatttatgtcacacgggtgtctgaaggaggccctgctgaaatcgctgggctgcagattggagacaagatcatgcaggtgaacggctgggacatgaccatggtcacacacgaccaggcccgcaagcggctcaccaagcgctcggaggaggtggtgcgtctgctggtgacgcggcagtcgctgcagaaggccgtgcagcagtccatgctgtcctagcagccaccaccatctgcgactcctgcctgccgcctctctgtacagtaacgccacttccacactctgtccccatctggcttctgctgaccgctgggccccagctcagaagggctatagctggtcccagaggcctggcctggccttccttcccttctcccatccctggcctggggcctctgggaccagctttctctcctggacaccgaggattggaaataagggcctggagctgagtagtagccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctccgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattcaaaaaaaaaaaaaaaaaaaaaaaaaaaaaaaaaaaaaaaaaaaaaaaaaaaaaaaaaaaaaaaaaaaa

SEQ ID NO: 276 - DNA, 3351 bp, Homo sapiens
gcgggaggggcgcgagcgggctggccgaggaggaggcggcggcgtggagctgcctcctgccggcgggccgggccgggccgagccccgggcgctgcggcgacgcctggatcctgcctccgccaggccggctgcctggtgccccgaggaggctgctgagccccaggccatggtcccctctcgcaggacgtggaacctgggagccacgccctcgctgcggggcctgtggagagtgggccgggccccggagcccgagccggggatggctcgccccgccccagccccagccagcccggccgcccgccctttcccacacaccggcccggggaggttgagaactgggcgtggaaaagataccccagtctgcggtgacgaggactccagtgcccgaagtgcagctcgcccagccctagctcagtgccgagcccttagcgtggactgggctggccccggaagcccccacgggctctacctgaccctgcaggtagaacacctgaaggagaagctcattagccaggcccaggaagtgagccgactgcgatctgagctggggggcaccgacttggagaagcaccgggacctgctgatggtggagaatgagcgactgaggcaggagatgcggcgctgtgaggccgagctgcaagagctgcgcacaaagccagcaggtccctgcccaggttgtgagcacagccaggagagcgcccagctccgtgacaagctgtcccagctgcagctggagatggcggaaagcaaaggcatgctgtcagagctgaacctagaggtgcagcagaagaccgaccggctggctgaggtggagctgcgactcaaggactgcctggctgagaaggcacaggaggaggagcggctcagtcggcgcctgcgtgacagccacgagaccattgccagcctgcgggcccagtccccacctgtcaagtatgtcatcaagacagtggaggtggagtcgtccaagaccaagcaggccctcagcgagtcccaggcccggaaccagcacctgcaggagcaggtggctatgcagaggcaggtgctgaaggagatggaacagcagctgcagagctcacaccagctgaccgcgcggctccgggcgcagattgccatgtacgagtcagagctggagcgggcccatgggcagatgctggaggagatgcagtccctggaagaggacaagaaccgggccattgaggaggcctttgccagagcccaggtggagatgaaggctgtgcacgagaatctagcaggcgtccggaccaacttgctgaccttgcagccggcactgcggaccctcaccaacgactacaatgggctcaagcggcaggtgcgcggcttcccactgctgctgcaggaggccctcaggagtgtcaaggccgagataggccaggccatcgaggaggtcaacagcaacaaccaggagctgctgcgcaagtaccgccgcgagctgcagctgcgtaagaagtgccacaatgagctcgtgcggctgaaagggaacatccgagtgattgctcgtgtccggccagtcaccaaagaggatggggaaggacctgaggccaccaatgctgtgactttcgatgccgacgacgactccatcatccacctgctgcacaagggcaagcctgtgtccttcgagctggacaaggtcttctccccacaggcctcgcagcaggacgtgttccaggaggtgcaggccctggtcacctcttgcattgatggcttcaatgtctgcatctttgcgtacggccagacgggcgccggcaagacgtacacgatggaggggaccgctgagaacccaggtatcaaccagcgggccctgcagctgctcttctccgaggtgcaggagaaggcgtctgactgggagtacaccatcaccgtcagcgctgcggagatctacaatgaggtcctcagggacctgctagggaaagagcctcaggaaaaactggagatccggctgtgcccagatggcagtgggcagctgtatgtaccagggctgactgagttccaagtgcagagcgtggacgacatcaacaaggtgtttgagtttggccacactaatcgcacgaccgagttcaccaacctgaacgagcacagctcccgctcgcacgcgctgctcatcgtgacggtgcgaggcgtggactgcagcacaggcctccgcaccacggggaagctgaacctggtggacttggctggctcggagcgcgtgggcaagtcgggggccgagggcagccgcctgcgggaggcgcagcacatcaacaagtcgctgtcggctctgggggacgtcattgctgccctgcgctcccgccagggccacgtgcccttccgcaactccaagctcacctacctgctgcaggattcgcttagtggtgacagcaagaccctcatggtggtacaggtgtcccccgtggagaagaacactagcgagacgctctattccctcaagtttgctgagagggtgcgctctgtggagctggggcctgggctacgcagggcagagcttgggtcctggtcaagccaggagcatctagagtgggagccggcttgtcagacgccacagccctcggcacgggcccactcagcccccagctctgggaccagtagccgccctggatccatccggaggaagctgcagccctcggggaagtcgcggccactgcctgtgtgacggatgtgaccccgctgggcctgaagctgggccctcactggcctgtccctgctgcagcgccaggacccccggaggtagaggcgagagtggaggctcttcttctgccccgtctcccctcaaagatgagaaacatgttcagaaggaaacggtgtctctcggctgtggctctgagtgcaaattgcatgggcggaaaggcgggggtggctgctcttcctggcaggcctgggccatcagcgaactgggccccgtgaggagggcgggagtgtggaggagggtgggcctctcacccaggctttctcggcccctctcctcagcttgcagagctggccagccccctccttagggggtgggcgaggagcctctgggcagacccaagaaccatggggactggggtgggttggtggcaccaatggcagccctccccgcccctctccttcaaggagggttcccgcagctggggggtgtgcggaggcgcatggcctcccgccacggggccgtgctgtgtttatggctggcagaggcagccagcgggtgggggattctgctgctcgctcacctgcctggctcgctggtctctcgaattttcttccctctgaaatcctatttaagaacttttggaagcttagccatttttacttattaaaataaaagaagcctttttacacaaaaaaaaaaaaaaaaaa

SEQ ID NO: 277 - DNA, 933 bp, Homo sapiens
atgcagcaaaataacagtgtgcctgaattcatactgttaggattaacacaggatcccttgaggcagaaaatagtgtttgtaatcttcttaattttctatatgggaactgtggtggggaatatgctcattattgtgaccatcaagtccagccggacactaggaagccccatgtacttctttctattttatttgtcctttgcagattcttgcttttcaacttccacagcccctagattaattgtggatgctctctctgaaaagaaaattataacctacaatgagtgcatgacacaagtctttgcactacatttatttggctgcatggagatctttgtcctcattctcatggctgttgatcgctatgtggccatctgtaagcccttgcgttacccaaccatcatgagccagcaggtctgcatcatcctgattgttcttgcctggatagggtctttaatacactctacagctcagattatcctggccttaagattgcctttctgtggaccctatttgattgatcattattgctgtgatttgcagcccttgttgaaacttgcctgcatggacacttacatgatcaacctgctgttggtgtctaacagtggggcaatttgctcaagtagtttcatgattttgataatttcatatattgtcatcttgcattcactgagaaaccacagtgccaaagggaagaaaaaggctctctccgcttgcacgtctcacataattgtagtcatcttattctttggcccatgtatattcatatatacacgccccccgaccactttccccatggacaagatggtggcagtattttatactattggaacaccctttctcaatccactcatctacacactgaggaatgcagaagtgaaaaatgccatgagaaagttatggcatggcaaaattatttcagaaaacaaaggataa

SEQ ID NO: 278 - DNA, 1993 bp, Homo sapiens
ccgctctgtctgcttcgccaccttctccccgagcactgcccggccggccgccatggctaacgtggctgacacgaagctgtacgacatcctgggcgtcccgcccggcgccagcgagaacgagctgaagaaggcatacagaaagttagccaaggaatatcatcctgataagaatccaaatgcaggagacaaatttaaagaaataagttttgcatatgaagtactatcaaatcctgagaagcgtgagttatatgacagatacggagagcaaggtcttcgggaaggcagcggcggaggtggtggcatggatgatattttctctcacatttttggtgggggattgttcggcttcatgggcaatcagagtagaagtcgaaatggcagaagaagaggagaggacatgatgcatccactcaaagtatctttagaagatctgtataatggcaagacaaccaaactacaacttagcaagaatgtgctctgtagtgcatgcagtggccaaggcggaaagtctggagctgtccaaaagtgtagtgcttgtcgaggtcgaggtgtgcgcatcatgatcagacagctggctccagggatggtacaacagatgcagtctgtgtgctctgattgtaatggagaaggagaggtaattaatgaaaaagaccgctgtaaaaaatgtgaagggaagaaggtgattaaagaagtcaagattcttgaagtccacgtagacaaaggcatgaaacatggacagagaattacattcactggggaagcagaccaggccccaggagtggaacccggagacattgttcttttgctacaggagaaagaacatgaggtatttcagagagatgggaatgatttgcacatgacatataaaataggacttgttgaagctctatgtggatttcagttcacatttaagcaccttgatggacgtcagattgtggtgaaatacccccctggcaaagtaattgaaccagggtgtgttcgtgtagttcgaggtgaagggatgccgcagtatcgtaatccctttgaaaaaggtgatctttacataaagtttgatgtgcagtttcctgaaaacaactggatcaacccagacaagctttctgaactagaagatcttctgccatctagaccggaagttcctaacataattggagaaacagaggaggtagagcttcaggaatttgatagcactcgaggctcaggaggtggtcagaggcgtgaagcctataatgatagctctgatgaagaaagcagcagccatcatggacctggagtgcagtgtgcccatcagtaaactctgcaaacaaattgcacaggtggattttctttccacatttgcctgatttgttctcagcaatccagctggagtgtcttatcaatcccagatgaactgagggacatctgttggtctatgtataacttttaaaattggtatagtatctacagagtgtataatttaaactaaccacaaagctttacatcttcattttgactgttccatagcaaaataaagcacttgaaaggaaacaaaactccctttcacacatggattattataagtttcaatcctggtatctgtgcttgatttttatcagttttgtgtaaatttttatgtttcatattttaaatttaaatcccacattgtaaagtttgtacaatttgtcctgaagctttgtgtttggctgcacctgcataagctgctacaaataaaataaaaaatttcatagcctgtatctatcatttaaatgcatggaaaaaaatgggctttgcacacaatgggtttggagctgactgggaacaatggaaaaaattacattagctgtggttgtaaagtttttttgtttttgggttttgttttttttttgttttttttttttttttttttaccattttgtgaaaggtttttgaaaatcgataataaaaagcggttggtgtaaatttaaaaaaaaaaaaaaaaaaaaaaaaaaaaaaaaaaaaaaaaaaaaaaaaaaaaaaa

SEQ ID NO: 279 - DNA, 1444 bp, Homo sapiens
ccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccccgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagtgcttccagagtcccaagagcttctctgggattttcttgtgatatctgattccccagtgaggcctgggacctttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctcc

SEQ ID NO: 280 - DNA, 2972 bp, Homo sapiens
atggccctccatttctcccatgcctcacttcaccttagttgtgtttttatttatttttatattttcgccaccttcactagcgagtacatcccctcactcttgaggtgggcactgatcagtaggaaataagattaatacctggctggtgataatttggggggaagacttaattagatagagatggataatgggatggcagcagacctttccccttgtgacccttcccctcatttccaaaatacacctctagagtagataattgcttaccattaagaagagttaatggaaggtgatactctgattctttggcattggaactacattcaatccgcggtatcctcggattagttctaggacccccttctccataccaaaacctgaggatgctcaagtccctgatagaaaatggtgtcatatttgtatgtgcatattctcttgtataatttaagtgatctctggattacttaatacaatgtaaacaatatgtaaatagttgttatagactgtattttaaaaattttgtattctttataaatttttctgaatattttcaatccatggctggtgaagtcctcggatgcagaccgtgtggatacagagtgccgattttatacaggagttcacctgtaactccctgtacctatcaacagctgactccaaattagaaagaaatagagtaagggagcctcagggagagtcctagcaaaacggattcgattaaacttcagttccttgtatagtttctttagttgtttatggtccattttctattttagcatttattattctatgtagtctatccaaagacgattaagggagttccacatgttttccggaacattttgaaaagagagcttatccagtgtacagatcctaataaagtgcacattcagtgtaattttatttttttaatatcttttttaatcctatttttcttcctcttttgctcagtaaattttgtatgaaactttaaaaggacttatggcatgtaaacattatttataaagtaagtcatggttataattatttttctcctgcctccttatgtatttatttcagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatctttctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatggaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaaatgtttttggtcttttataattctcattaaaagaatatctggcaaattaaaaaaaaaaaaaaaaaaa

SEQ ID NO: 281 - DNA, 3100 bp, Homo sapiens
gtcggcggcggctgcgggaactttcccagcggatctaatggctgcgcgcgggccgctgtgaggcgcggcggcgagcgacgggcgcggggccgcggagcagcgagcgagcgagcgagcgcgaggccggagccccggccaggcccggccgacccgccgagcccgcgatgcgccccggggccgccccccggcgcagctgacgccccgcggccccgcgaagaccccggccggccggtcccggaggaagcggccgccgccgccgccgcccagcccagcgcccgcgccgcccgggcaccatggcggggaaggcggccgccccgggcaccgcggtgctgctggtcacggccaacgtgggctcgctcttcgacgacccagaaaacctgcagaagaactggcttcgggaattttaccaggtcgtgcacacacacaagccgcacttcatggccttgcactgtcaggagtttggagggaagaactacgaggcctccatgtcccacgtggacaagttcgtcaaagaactattgtcgagtgatgcgatgaaagaatataacagggctcgagtctacctggatgaaaactacaaatcccaggagcacttcacggcactaggaagcttttattttcttcatgagtccttaaaaaacatctaccagtttgactttaaagctaagaagtatagaaaggtcgctggcaaagagatctactcggataccttagagagcacgcccatgctggagaaggagaagtttccgcaggactacttccccgagtgcaaatggtcaagaaaaggcttcatccggacgaggtggtgcattgcagactgtgcctttgacttggtgaatatccatcttttccatgatgcttccaatctggtcgcctgggaaacaagcccttccgtgtactcgggaatccggcacaaggcactgggctacgtgctggacagaatcattgatcagcgattcgagaaggtttcctactttgtatttggtgatttcaacttccggctggattccaagtccgtcgtggagacgctctgcacaaaagccaccatgcagacggtccgggccgccgacaccaatgaagtggtgaagctcatatttcgtgagtcggacaacgaccggaaggttatgctccagttagaaaagaaactcttcgactacttcaaccaggaggttttccgagacaacaacggcaccgcgctcttggagtttgacaaggagttgtctgtctttaaggacagactgtatgaactggacatctcgttccctcccagctacccgtacagtgaggacgcccgccagggtgagcagtacatgaacacccggtgcccagcctggtgtgaccgcatcctcatgtccccgtctgccaaggagctggtgctgcgggtgagtgtgtgctgccccagccctgggcacagagggatgtggagcgctgggtctggtctggcccagccctggtgacagggccccaggggtgggggtcggagagcgaggagaaggttgtcacctatgaccacattgggcccaacgtctgcatgggagaccacaagcccgtgttcctggccttccgaatcatgcccggggcaggtaaacctcatgcccatgtgcacaagtgttgtgtcgtgcagtgacgtggtgggaagagatgccagcgccacgagaggacacttcgtgagcctccctgtagccgtggaccgaatacgcactcttgaaagctgcatcgagaacccgcccaagcgccacctgctagacggccagccccacacttcgcttcagcctccggaccattccggagcagcctcacatacctcactgtctcgtctgtctatgtgacattaagtagaaatattggttttttttttttttttttaaataagtcacagtcctgttgtcaaaactctaatagacagcaaagagggtctgtaccgtagacttcacagttttcagtttttaatgattgccagtggaggggcttcttcagcacagagaccccccactgtgtccagggaccccctctgccaggtggaggtgtgtccaggggctggggaagccgagacgggcactccctctgccggccggcagcgtggccctgagcatggcaagggggtctgtctctgccgatgctccttccgcggcactgactctgcgccgtgtcacatggtttttgaatcacactgcagctgctttccatttttatatatatataaatatatataaatatatactttttaaaaataatttataaatcttaccaaaacttatgctaaatatactttccagtatgaacgcacaggagagtcccatcagcaggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaataaaaaaaaaaaaaaaaaaaaaaa

SEQ ID NO: 282 - DNA, 3643 bp, Homo sapiens
  modified_base (3536)..(3536): a, c, g, t, unknown or other
gtcttctcagccgggacgccagcggttctgattacagacctcggctgcccgacaactacacgcaggacacgtggcggaagctgcacgaggcggtgcgggccgtgcagagcagcacctccatcaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctccctgtttcatgtatttccaaaagttgtaaactttggtggctgatttttcgtaagtcaggtttctaagtgagctccctgaggtgccaaggccatggtgtccgccctgctgcgtctgttcgtcagctgagttccttgtgaatctctgttttaggggttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacctaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttttatctttgaaaattttcatttatgagttccatgatatgtggtctaagaaagaccaaacagatttctatttttttttcttataagttcgttgtgtctanagattgttaatattgtaatttaatgtagacttactttgaataaaattagtttaattggccttaaaattacattaataaaactttgtgatatgcaaatgacacattca

SEQ ID NO: 283 - DNA, 3449 bp, Homo sapiens
ccgagaggcggggcggtgcccccaccgcaggcccgcggcgccctctgcaggccacaggcagcgactcaccagttgcctcatctttcctctcctccctcttggggctttcctcaggccacattttttgtgtgtctgggcagtctctcagcctccgactcccgtccctttcttccacttccaggccgggcgtgttagtgtcttcgcgggaaaactgccaataaagtttttcttcttctcgctcccaagatccccgcctccccttaagcaccgcgagatctgacggcgcggctaccatggcggcggcatttgaagcctcgggagccttagcagcagtggcgactgctatgccggctgagcatgtggccgtgcaggtcccggccccagagccaacacccgggcctgtgaggatcctgcggaccgctcaggatctcagcagcccgcggacccgcacgggggatgtgctgttggcggagccggccgacttcgagtcactgctgctttcgcggccggtgctggaggggctgcgggcggccggcttcgagaggccctcgccggtgcagctcaaggccatcccgttggggcgctgcgggctcgatttaattgttcaagctaaatctggcaccgggaaaacctgtgtgttctccaccatagctttggactctcttgttcttgaaaacttaagtacccagattttgatcttggctcctacaagagaaattgctgtacagatacattctgttattacagccattggaataaaaatggaaggcttagagtgtcatgtctttattggagggaccccattatcacaagacaaaaccagacttaaaaagtgtcatattgctgttggatctcctggcagaattaagcaactcatagaacttgactacttgaacccaggcagtatacgcctctttattcttgatgaagcagataagcttttagaagaaggcagcttccaggagcaaataaattggatttattcttccttgcctgccagtaaacagatgctggcagtatcagctacttatcccgaatttttggctaatgctttgacaaagtacatgagagatcccacttttgtaagactgaattccagtgatccaagtctcataggtttgaagcagtattacaaagttgtcaattcataccctttggcacataaggtttttgaggaaaagactcagcatttacaggaactgttcagcagaattccatttaatcaagctttagtcttttctaatttgcacagcagagcacaacatttggctgatatcctttcttctaaaggctttcctgctgagtgcatttcaggcaatatgaatcagaatcagcgtcttgatgctatggctaaactgaagcactttcattgcagagtcctcatttccacagatttgacttctcgtgggattgatgctgagaaggtgaatctggttgtaaatctggatgtaccattggattgggagacatacatgcatcggattgggagagctggccgttttggtacattggggctgacagtgacctactgttgccggggagaggaagaaaatatgatgatgagaattgcccagaaatgtaatatcaaccttctccctttaccagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagaaagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggattatgaggagtactggagagcttactacagggcatggcaagaatattatgctgccgcttctcattcatattattggaatgctcagagacatccaagttggatggcagcttatcacatgaataccatttatctacaagaaatgatgcatagtaaccagtgattataggatatacctgagaccatcaggaactgtcaacaaatgatacctttggatatccatcctcctcgacttatagtacagtggtgtatagtggcatttctgataaacttgaaaagacttgagtctttccactgggacacatccatttttcagattgttttgatttaggccaggtatattatcttcatttttaagagtttctttaagaaacttcatcagattgttgaaagataatttttgggacatagagctgaaagtttcagggtgccattttctataagatcttcccaaaagaaacatttaaaaagatgacatataccaccacttacttaaaaacaataaaagcaatagatttgattagtaatattattgctgtggagttctttacaaagggcttaggctgcatttccttctatagaggtgcattcttgtagaaatttgtagcatggtagatcagaaaatcctcttaggttttaggcaggaaggaatatttaaacattgctttagattttcctaaaggtatttgatttgatctgttagcttccagtaaaaatatttgtttttagtaaaaacaaatttaaatatatttacatgtttgttgtttatcttttgaatgtcttttgaggctgtgaaagctgtccacatttttgctgtgtattaaatagctgtgggtcatcaaaa

SEQ ID NO: 284 - DNA, 10299 bp, Homo sapiens
atggaatcggaggaggagcagcacatgaccacgctgctgtgcatgggcttctcagaccccgccaccatccgcaaggccctgcgcctggccaagaacgacattaacgaggccgtggcactgctcaccaacgagcggccgggcctcgactacggcggctacgagcccatggacagcggcggcgggggcggcttcgaccccccgcccgcctaccacgaggtggtggacgcggagaagaatgatgagaatggaaactgctcaggggaaggaattgaattccctacaacaaatttatatgaactggaaagccgtgttttgactgatcattggtccatcccttacaagcgagaagaatcactaggcaaatgcctgttggcatctacctacctagcaagacttggtctttccgagtctgatgagaattgtagaaggtttatggacaggtgtatgcctgaagcatttaaaaagctcctgacatcaagtgctgttcacaagtggggtactgaaattcatgaaggaatttacaacatgttgatgctattaatagaactggtcgcagagagaataaaacaagatccaattcccactggtctcctgggtgtgcttacaatggctttcaatcctgataatgaataccattttaaaaacagaatgaaagtgtctcaaaggaattgggcagaagtgtttggagagggaaatatgtttgctgtttcacctgtatcgactttccaaaaggagcctcatggatgggttgtggatttggtaaataagtttggagaattaggtggatttgcagcaatccaagccaagctccattcagaagatatagaacttggggctgtctcagcactgattcagcccttaggagtgtgtgcagagtacctcaattcctccgtggtacagcccatgctagacccagtcattcttactacaatccaggatgtacggagtgtagaagagaaagacctcaaagacaagagattggttagcatccctgagctcttgtctgccgttaagttactttgcatgcgcttccaaccggatctggtgacaattgtggatgaccttcgactagatattctattgcgcatgctgaaatcaccacatttcagtgctaagatgaattctctcaaagaagtaaccaaactaatagaagatagcactttatccaaatctgtgaagaatgctatagatacagacagattattagattggctagttgaaaactcagttctgtcgattgcactggaaggcaacatagaccaagcacaatactgtgaccgtataaagggaattattgaactcttgggtagtaaattgtcgttagatgaactcactaaaatttggaagatacagtcaggacaatcatctactgtgattgagaacattcatactattattgctgcagcggctgtgaaatttaattcagatcagcttaatcatttgtttgttctcattcagaagagctgggagactgagagtgatagagtaagacagaagcttttgagcctgattggacgaataggccgggaagctcgctttgagaccacttctggaaaggttttagacgtactctgggaactggctcaccttccaaccctgcccagtagccttattcagcaggccttggaggagcacctgacaatccttagtgatgcatatgcagtgaaagaagcaatcaagaggagctacatcatcaagtgcatagaagatattaagaggagcattattcaagacttgaagaagaattttgaaatagtgaaattggtaacgggaagtttgatcgcttgtcatcggcttgcagctgctgtggccgggcctggaggcttaagtggctcgacactagtggatggccggtacacttaccgggagtatttagaggcacatctaaaatttctagcgtttttcttgcaagaagctactctgtatctgggctggaatcgtgccaaggagatctgggagtgtcttgtaactggccaggatgtttgtgaattagatagagagatgtgttttgaatggtttacaaaaggacagcatgatcttgagagtgatgttcagcagcagctcttcaaggagaaaattcttaaattggagtcatatgaaatcactatgaatggttttaacttatttaaaactttttttgaaaatgtgaatctttgtgatcatcgattgaaaagacaaggagctcagttgtatgtagaaaagctggaattgataggaatggatttcatttggaaaatagccatggaatcacctgatgaagaaattgctaatgaagctattcagctaatcataaactatagttacattaatctaaatcctagattaaagaaggattcagtatctttacataagaaattcattgctgattgctacacaagattagaagcagccagttcagcacttggtggccccactctaacacatgctgtgaccagagcaacaaaaatgcttacagcaactgccatgccaactgtagcaacctcagttcagtctccttatagatctactaaacttgtaataattgagagattgctgcttctggcagagcgctatgtgatcactatagaggatttttactctgttccacgaactattctacctcatggtgcctcatttcatggacatcttttaacccttaatgttacctatgagtctaccaaagataccttcactgtcgaggctcacagtaatgaaaccatagggagtgtccggtggaaaatagccaagcagttgtgctctcctgtggataatatacagatatttacaaatgatagcctgctgacagtgaataaagatcaaaagctactccaccaactgggcttttctgatgaacaaatccttacagtgaagacttctggcagtgggaccccatctgggagttcagcagattcttcaaccagctccagcagcagcagcagtggggtttttagttcttcatatgccatggagcaggagaaatccctccctggtgtagtgatggctctcgtatgtaacgtatttgacatgctttatcagctcgccaatctggaagagccaaggataactctacgagtacggaagcttctgctcttgatacccactgatccagccattcaggaagcccttgatcaacttgattctttaggaagaaagaaaacattgctgtctgaatcaagttctcagtcctcaaaatctccatccctgtcatcaaagcaacagcaccagccaagtgccagttcaattttagaaagtctgtttcgatcttttgccccgggaatgtctaccttcagagtgctctacaacttagaagttctaagctccaaactcatgccaacagctgatgatgacatggccagaagctgtgccaaatccttctgtgaaaacttcctcaaagctggcggtttgagtttggttgtaaatgtcatgcagagagactccatcccatcagaagtagactatgaaacaaggcagggtgtttattccatctgtctacagcttgcaagatttttacttgtcggacaaacaatgcccacgttattagatgaagacctcaccaaagatggtatagaagcactttcttcccgcccattccgaaatgtcagccggcagacaagcagacagatgtccttatgtggtaccccagaaaagtcatcctaccgacagttgtccgtgtctgataggtcttctattagggttgaggaaatcatccctgctgctcgagttgcaatacaaacaatggaagtaagtgatttcacttctactgtggcttgcttcatgagattgtcatgggctgcggctgcaggacggcttgatcttgttgggagtagccagccaattaaagaaagtaattccctgtgtcctgctggaattcgaaacagactcagcagttcaggaagcaattgcagctctggaagtgaaggagaaccagtagccctgcatgcgggaatctgtgttcgacaacagtctgtatccaccaaagactcgctgattgcgggagaggctttgtctcttcttgttacgtgcctacagcttcggagccagcaactggcatctttctataacttgccctgtgttgctgatttcatcattgatattctgctcggatcaccaagtgctgagattcgccgggttgcctgtgatcagctgtacactcttagtcagacagacacatcagcgcatccagatgtgcagaagccaaatcagtttcttctaggcgtaatcctcacggctcagctgcctctctggtctccaactagtattatgagaggagtcaatcagagactgttatctcagtgtatggagtattttgatttgagatgccagttattagatgatctgacaacttcagaaatggagcagttaaggatcagcccagctacgatgcttgaagatgagattacttggctggataactttgaacctaatcgtacagctgaatgtgagaccagtgaagcggacaacatcttactggcagggcacttacgcctcatcaagacccttctttcactctgtggggcagaaaaggaaatgcttggttcatcactcattaaaccattgttagatgacttccttttccgagcttctagaattattttaaatagtcattctccagctggcagtgccgccatcagtcaacaggactttcatccaaagtgtagtacagcgaatagccgattggcagcctatgaagtccttgtgatgttggctgatagttcaccttcaaatcttcaaattattataaaagaactgctttctatgcatcaccagcctgaccctgctcttaccaaggagtttgattaccttcccccagtggatagcaggtccagttcagggtttgtggggctgagaaatggtggtgcaacttgttatatgaatgcagtcttccagcagctgtatatgcaacctgggctccctgagtcattactttcagtggatgatgacacagacaatccagatgatagcgtgttttaccaagtgcagtctctctttggacatttaatggaaagcaagctgcagtactatgtacctgagaatttttggaagattttcaagatgtggaataaagaactttatgtgagagaacagcaggatgcatatgaattctttactagtctcattgatcagatggatgaatacctcaagaaaatggggagagaccaaatttttaagaatacatttcagggcatctactctgatcagaagatctgtaaagactgtcctcacagatatgagcgtgaagaagctttcatggctctcaatctaggagtgacttcttgtcagagtttggaaatttctttggaccaatttgttagaggagaagttctagaaggaagtaatgcgtactactgtgaaaagtgtaaagaaaagagaataacagtgaaaaggacctgtattaaatctttacctagcgtcttggtaattcacctaatgagatttgggtttgactgggaaagcggacgctccattaaatatgatgaacaaataaggtttccctggatgctaaacatggagccttacacagtttcaggaatggctcgccaagattcttcttctgaagttggggaaaatgggcgaagtgtggatcagggcggtggaggatccccacgaaaaaaggttgccctcacagaaaactatgaacttgtcggtgtcatcgtacacagtgggcaggcacacgcaggccactactattccttcattaaggacaggcgagggtgtggaaaaggaaagtggtataaatttaatgacacagttatagaagaatttgacctaaatgacgagaccctggagtatgaatgctttggaggagaatatagaccaaaagtttatgatcaaacaaacccatacactgatgtgcgccgaagatactggaatgcctatatgcttttctaccaaagggtgtctgatcagaactccccagtattaccaaagaaaagtcgagtcagcgttgtacggcaggaagctgaggatctctctctgtcagctccatcttcaccagaaatttcacctcagtcatcccctcggccccataggccgaacaatgaccggctgtctattcttaccaagctggttaaaaaaggcgagaagaaaggactgtttgtggagaaaatgcctgctcgaatataccagatggtgagagatgagaacctcaagtttatgaagaatagagatgtatacagtagtgattatttcagttttgttttgtctttagcttcattgaatgctactaaattaaagcatccatattatccttgcatggcaaaggtgagcttacagcttgctattcaattcctttttcaaacttatctacggacaaagaagaaactcagggttgatactgaagaatggattgctaccattgaagcattgctttcaaaaagttttgatgcttgtcagtggttagttgaatattttattagttctgaaggacgagaattgataaagattttcttactggagtgcaatgtgagagaagtacgagttgctgtggccaccattctggagaaaaccctagacagtgccttgttttatcaggataagttaaaaagccttcatcagttactggaggtactacttgctctgttggacaaagacgtcccagaaaattgtaaaaactgtgctcagtactttttcctgttcaacacttttgtacaaaagcaaggaattagggctggagatcttcttctgaggcattcagctctgcggcacatgatcagcttcctcctaggggccagtcggcaaaacaatcagatacgtcgatggagttcagcacaagcacgagaatttgggaatcttcacaatacagtggcgttacttgttttgcattcagatgtctcatcccaaaggaatgttgctcctggcatatttaagcaacgaccacccattagcattgctccctcaagccctctgttgcccctccatgaggaggtagaagccttgttgttcatgtctgaagggaaaccttacctgttagaggtaatgtttgctttgcgggagctgacaggctcgctcttggcactcattgagatggtagtgtactgctgtttctgtaatgagcatttttccttcacaatgctgcatttcattaagaaccaactagaaacggctccacctcatgagttaaagaatacgttccaactacttcatgaaatattggttattgaagatcctatacaagtagagcgagtcaaatttgtgtttgagacagaaaatggattactagctttgatgcaccacagtaatcatgtggacagtagtcgctgctaccagtgtgtcaaatttcttgtcactcttgctcaaaagtgtcctgcagctaaggagtacttcaaggagaattcccaccactggagctgggctgtgcagtggctacagaagaagatgtcagaacattactggacaccacagagtaatgtctctaatgaaacatcaactggaaaaacctttcagcgaaccatttcagctcaggacacgttagcgtatgccacagctttgttgaatgaaaaagagcaatcaggaagcagtaatgggtcggagagtagtcctgccaatgagaacggagacaggcatctacagcagggttcagaatctcccatgatgattggtgagttgagaagtgaccttgatgatgttgatccctagaggaacatgcccagcctgagaggagtcaagacacaatactggatgctcagcaccttcttggaatcagaatctcgaaccctttggaagagcctggagattggactgggaaagctgctgtgacttgggcggatcgtgtatttctcaaggaaagcatttttaagccactagaaggtttgggagctgtttggcagtgggagaactccggcatgtggatcagctgtcccgggagcgtggtctatatgtggattcacatttctgtggagattttcggaaatagagccagtggcagacttttttgttacacgaacatacaagagtgagcataaagctgttgctttctctacgatgctacaaaagaaattcctttggtttttatattttaagaaaaagcaagctgcttttagatatgtgggggcaaatttttaatcttgcagtaatattaaacaggaatatccaatttaaaatgatgtaaagatgtaataaaattccttttcattgtaaaatagtaattaagtcaatttacacagacctttgtatttaatatgtctccctatttgtatagaatttcagatgggtctagatgagaaccctatgcataagcttggatcttgatgaaaggttaccaggatcaggatcaaaaattgggaaatactaagctcttgaagatatttttctgatataattagattgaaaagagcaattttgaaaatgctgtgttctccagaagtacagggtgcattatttgacatcaattacttaaagaagttatgagttgttccccaaacagattttaaaaacagcaaaataaaagcactttaagatataattttactgagtttaacttcacagaattatctttttaatgcttggagacatattgaataaactgtagtcttaaatcatgtgatctgcaatcgtttgcttttgcttaaaacataattactgaaacccttggtattggttgtatatgaagttaactatttgagttggtacacactgcttgtgagtttcatagttattgtaatgcagagaaggaatttgagaatttgtttctcctcaacatgactaattaacactgaaaagtcagtcaaggtttaagatttattttcccagaaataaatataaagcaattgaataaccatccatttagtcgtatttccaaagtatagcaccattcactcatttataccagctcccttttatggtgtgggggagaggtttacacccacatatttcatatatattttgtacattttgtattttgaattgctcacattttcggccctgttttgcctttagttacaggtcctgccttattttcatctcaccatgcacagaactagggagccttaggaagtgccaggttttcactgtcagatttgccaagtcacagaggcgcagccagccctgaagtgcctgtctggctgctgtggcattgtgtgggcatgtggccaggcagatggcatctcattactgtgctctcgccatggcccagtcttttcattctctggcagtgagggtttctgtgctgtcagacttcattgttattctgtgacttgctggaggttggcagtggcctttgtcaaacacactgagaagatggaagggccagcacttaagagcagaactgtacccttagagaaacggacagaggcgagtggcaaacttcagacggttccaatggtcttgcagtttgaaatgtgatgttctaccattggttttgagtacgtgaatacttcctgtcctactgtttcccctaccctattctcaccttctctccgcccacatcctcaccaagagattgtgtgggacatgaccttgaaatgctggcgatgatccacactgggatatcatcgctggcgactgcactctcaggagcccaaaatcaggagtgaaattgccacttctagtccccttatttcctatggaaacaacgccttccgcacccctagcacctgccgtcctcactgtaaagcttcatcaggatcgtccaccgtgtatattatacgcttcagatcatgttgcttatattgttgctgcaatgaccatcgttttcactttgctggtaaccacttgattgctgacagctacagtcaatgaacctgctgatgactttttttaatgtagtacaacagtgacagttatgacaggcttaccttggaagagttgtcatttttactgccaattttttggatgaagatgtttttataaacctttcaaaatggtctgcaaacagagcaggaattgcacaattaactcaataatgctgtgtgttctcaagaagctcccttagtgaggccgatcttaagatggccgattctgcccgttgaaggcatcctgggaaagaaaacaagcatcccagcgggcatctcaccacgacttctcctggagtcctcacacggtcactgacaactacagtcagttttaggaactagagtgccgtatcatcagacttaccctgtcctgccccaccttccctgctaacatcgaggtgtgtgcagttaccttctgagcttggaacaagcagactggaattttcctctgctacctcttgtgtataaaatcttgtttataaaatttcaaaaggaagtagatacactagggaagaaccttaattctaaatttggttcatgtgtggcaaagttcttagcttctaagagtataaaataaatttttcaaaaacag

SEQ ID NO: 285 - DNA, 2629 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccgcgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggtaggggcccacttcaccgtactaaccagggaagctgtccctcatgttgaattttctctaacttcaaggcccatatctgtgaaatgctggcatttgcacctacctcacagagtgcattgtgagggttaatgaaataatgtacatctggccttgaaaccaccttttattacatggggtctaaaacttgacccccttgagggtgcctgttccctctccctctccctgttggctggtgggttggtagtttctacagttgggcagctggttaggtagagggagttgtcaagtcttgctggcccagccaaaccctgtctgacaacctcttggtcgaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtggagctggaagggtcaacatcttttacattctgcaagcacatctgcattttcaccccacccttcccctccttctccctttttatatcccatttttatatcgatctcttattttacaataaaactttgctgcca

SEQ ID NO: 286 - DNA, 3676 bp, Homo sapiens
ggccgagggggcatcatgaagcgggctggcggcgctgccgctcccgggcggccgcgggcgggaggtgcttcccaaggaccgtagatgcctctctagagcatgagctcaggcaagagtgcccgctacaaccgcttctccggggggcccagcaatcttcccaccccagacgtcaccacagggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaacaggatccaggccaggctgtggtttcccctgaaccagccctggacctttctgagccaggctggccacatggggtggtctcggggtttctgcctgccccgtgggcataggtggacaggctctggcagccgggcagtgccctccccgtcccatgctcggcgagcctccctctactcggcactgtccttgctgcccagcccctctctgggtgccaggtacgacgcttgccccggcccaccctccatccccaccctccatccccaccctagatggagcgagggcctttttactcaccttttctaccgtttttagactgtatgtagatttggttacctcctggttgaaataaatgctccacagactgtggctgtgagtggggacagctcctcgggacaagggggctgtgtgtggccttgaggttggtgtgcacaggcactggctgctgtgagtgggggggcatggggcagtttcctttggtggaccccaggacttcggcccactccggggcctcccctccctgctaggaggcaactcgtcacacccaagctgctggcctccagtcccatctcccccaacacatgtgcccccaaaaagtgagccaggcacctctgtttcctgctgtttattgacagccgacggcagcgccttgcccagacctcccctgcccacctgctggagcccagcctgtgccgccctctgaggagaggcctggggggacagctgggcacgtccactcgcagggaaacacggggtgagacagcaggaaggggccctgcacgccgggacgccacctccgccagccgcctccacccgccccacaccacaatcgctggttttcggcattttttaaattttttttttaagaaacgtcaaagttgtgcccaacactgtggatcagcaaacacgatagaggagaccagtcagtacttcttggagggggcaggaggagagaggaaaagggagggcgagaatgaccacacaacacagccttggaccatgagcagaagcgtccgtgggaactccactggggtggatgggctgcctgcacagcccctggagagggggccaggcacaccctcagaggagctgcaagcccgtggcctggcctgctacatgccctgcttccacgtggctgccacgctgacacacccacattcaccaaacccacccgcgccctgggacgcagccacgccaggaggaggacacggccgccgagagcaaggcacaacctcgagttcttggggcgcagagaacttaggagagaagcacggaggagcccccggcagagcacccgcccccgggccccagccttccacctgtgctagcagcctggggcctccactctggccggaggaaggaccgcaggcagacagcctgggcctctaacagcttttgtccggagctagacttcgtgtcctttcagttggtaaatggttttctatagaatcaataatatttctttctttaaatatatatttgttaaagttatacctttttgtttctctggggaaatccgcctcagctcattcccaataaattaatactcttgatagcttaaaaaaaaaa

SEQ ID NO: 287 - DNA, 2788 bp, Homo sapiens
aaggcagggggcggggcgtctccgagcggcggggccaagggagggcacaacagctgctacctgaacagtttctgacccaacagttacccagcgccggactcgctgcgccccggcggctctagggacccccggcgcctacacttagctccgcgcccgagagaatgttggaccgacgacacaagacctcagacttgtgttattctagcagctgaacacaccccaggctcttctgaccggcagtggctctggaagcagtctggtgtatagagttatggattcactaccagattctactgtatgctcttgacaactatgaccacaatggtccacccacaaatgaattatcaggagtgaacccagaggcacgtatgaatgaaagtcctgatccgactgacctggcgggagtcatcattgagctcggccccaatgacagtccacagacaagtgaatttaaaggagcaaccgaggaggcacctgcgaaagaaagcccacacacaagtgaatttaaaggagcagcccgggtgtcacctatcagtgaaagtgtgttagcacgactttccaagtttgaagttgaagatgctgaaaatgttgcttcatatgacagcaagattaagaaaattgtgcattcaattgtatcatcctttgcatttggactatttggagttttcctggtcttactggatgtcactctcatccttgccgacctaattttcactgacagcaaactttatattcctttggagtatcgttctatttctctagctattgccttattttttctcatggatgttcttcttcgagtatttgtagaaaggagacagcagtatttttctgacttatttaacattttagatactgccattattgtgattcttctgctggttgatgtcgtttacattttttttgacattaagttgcttaggaatattcccagatggacacatttacttcgacttctacgacttattattctgttaagaatttttcatctgtttcatcaaaaaagacaacttgaaaagctgataagaaggcgggtttcagaaaacaaaaggcgatacacaagggatggatttgacctagacctcacttacgttacagaacgtattattgctatgtcatttccatcttctggaaggcagtctttctatagaaatccaatcaaggaagttgtgcggtttctagataagaaacaccgaaaccactatcgagtctacaatctatgcagtgaaagagcttacgatcctaagcacttccataatagggtcgttagaatcatgattgatgatcataatgtccccactctacatcagatggtggttttcaccaaggaagtaaatgagtggatggctcaagatcttgaaaacatcgtagcgattcactgtaaaggaggcacagatagaacaggaactatggtttgtgccttccttattgcctctgaaatatgttcaactgcaaaggaaagcctgtattattttggagaaaggcgaacagataaaacccacagcgaaaaatttcagggagtagaaactccttctcagaagagatatgttgcatattttgcacaagtgaaacatctctacaactggaatctccctccaagacggatactctttataaaacacttcattatttattcgattcctcgttatgtacgtgatctaaaaatccaaatagaaatggagaaaaaggttgtcttttccactatttcattaggaaaatgttcggtacttgataacattacaacagacaaaatattaattgatgtattcgacggtctacctctgtatgatgatgtgaaagtgcagtttttctattcgaatcttcctacatactatgacaattgctcattttacttctggttgcacacatcttttattgaaaataacaggctttatctaccaaaaaatgaattggataatctacataaacaaaaagcacggagaatttatccatcagattttgccgtggagatactttttggcgagaaaatgacttccagtgatgttgtagctggatccgattaagtatagctcccccttccccttctgggaaagaattatgttctttccaaccctgccacatgttcatatatcctaaatctatcctaaatgttccttgaagtatttatttatgtttatatatgtttatatatgttcttcataaatctattacatatatatagataaaatgtcagtgtctttcttcttttttgaaggtacatacttcacagtttccatcttgtatttacctaaatttggaacacagtatgcaggaacatcaggcatcattttgaagaactttgaaatagaactttcaaagcaaaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatgggggttggggtaagaagatggtggtaaatatgaaaagtaatctttaataacttctgcttttgtataaaattgtaagtgaagtcaaaagaaaaaaaaaaaaaaaaaaaaaaaaaaaaaaaaaaaaaaaaaaaaaaaaaaaaaaaaaaaaaaaaaa

SEQ ID NO: 288 - DNA, 1038 bp, Homo sapiens
atgagtcacctcttcgatccccggctgcctgccctggccgcctcgcccatgctgtatctgtacggtcccgagagacccggcctccctctggccttcgcccccgcggctgctctagctgcctcgggccgggccgagaccccgcagaagcctccctacagctacatcgcgctcatcgccatggcgatccaggacgcgcccgagcagagggtcacgctcaacggcatctaccagttcatcatggaccgcttccccttctaccacgacaaccggcagggctggcagaacagcatccgccacaacctctcgctcaacgactgcttcgtcaaggtgccccgcgagaaagggcggccgggcaagggcagctactggacgctggacccccgctgcctggacatgtttgagaacggcaactaccggcgccggaagaggaagcccaagccgggccccggggccccggaggccaagaggccccgcgccgagacgcaccagcgcagcgcggaggcgcagccggaggcggggagcggggcagggggctcgggccccgcaatctcccgcctgcaggcagcgcccgcgggcccctcgcccctcctggacggcccctctccgccggcgcccctccactggccggggaccgcgtccccgaacgaggacgctggtgacgctgcccagggcgcagcggccgtggcggtcggccaggcagcgcgcacaggggacggcccggggtcccctctgcgccccgcctcccgcagctctccgaagagctccgacaagtccaagagcttcagcatagacagcatcctggcgggaaagcagggccagaagccgccttcaggggacgaactcctagggggtgccaagcctgggcccggcggccgtctgggtgcctcgctcctggccgcctcctccagcctccgtccgcctttcaacgcttccctgatgctcgacccgcatgtccagggcggcttttaccagctcgggatccccttcctctcttatttccccctgcaggttcccgacacggtactccacttccagtaa

SEQ ID NO: 289 - DNA, 2957 bp, Homo sapiens
gaattcccaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttcttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagcggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaattttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaaataaataattaaaaattaagaataaataaacgagttgacctcggtcacaaaagcagttttactatcgaatcaatcgctgttatttttttttaatgtaatttgtacatcttttttcaatctgtacatttgggctgtcttgtatgtttttatgctcctttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaaa

SEQ ID NO: 290 - DNA, 1766 bp, Homo sapiens
cggtcaggtccagcacttgggagctgactgtgctggaggtgacaggctttgcggggtccgcctgtgtgcaggagtcgcaaggtcgctgagcaggacccaaaggtggcccgaggcagccgggatgacagctctccccaggaatcctgctgcctgctgagaaacatggtcagcaagtcccgctggaagctcctggccatgttggctctggtcctggtcgtcatggtgtggtattccatctcccgggaagacagtttttattttcccatcccagagaagaaggagccgtgcctccagggtgaggcagagagcaaggcctctaagctctttggcaactactcccgggatcagcccatcttcctgcggcttgaggattatttctgggtcaagacgccatctgcttacgagctgccctatgggaccaaggggagtgaggatctgctcctccgggtgctagccatcaccagctcctccatccccaagaacatccagagcctcaggtgccgccgctgtgtggtcgtggggaacgggcaccggctgcggaacagctcactgggagatgccatcaacaagtacgatgtggtcatcagattgaacaatgccccagtggctggctatgagggtgacgtgggctccaagaccaccatgcgtctcttctaccctgaatctgcccacttcgaccccaaagtagaaaacaacccagacacactcctcgtcctggtagctttcaaggcaatggacttccactggattgagaccatcctgagtgataagaagcgggtgcgaaagggtttctggaaacagcctcccctcatctgggatgtcaatcctaaacagattcggattctcaaccccttcttcatggagattgcagctgacaaactgctgagcctgccaatgcaacagccacggaagattaagcagaagcccaccacgggcctgttggccatcacgctggccctccacctctgtgacttggtgcacattgccggctttggctacccagacgcctacaacaagaagcagaccattcactactatgagcagatcacgctcaagtccatggcggggtcaggccataatgtctcccaagaggccctggccattaagcggatgctggagatgggagctatcaagaacctcacgtccttctgacctgggcaagagctgtagcctgtcggttgcctactctgctgtctgggtgacccccatgcgtggctgtgggggtggctggtgccagtatgacccacttggactcaccccctcttggggagggagttctgggcctggccaggtctgagatgaggccatgcccctggctgctcttatggagccgagatccagtcagggtgggggcgctggagccgtgggagcccggccagggcagggggctcgtcgctgtggcaccccctctctgccagcaccaagagattatttaatgggctatttaattaaggggtaggaaggtgctgtgggctggtcccacacatccaggaaagaggccagtagagaattctgcccactttttataaaaacttacagcgatggccccaccaaggcctagacacggcactggcctcccaggagggcaggggcattgggaatgggtgggtgccctccagagaggggctgctacctcccagcaggcatgggaagagcactggtgtgggggttccaccgagaaggggacctcatctagaaaagaggttacaaacctaccattaaactatttttcctaaaacggaaaaaaaaaaaaaaaaaaaaaaaaa

SEQ ID NO: 291 - DNA, 2385 bp, Homo sapiens
gcgccattttgaaagtggagtcgcctgcccctgccgctgccgccgccgccgtcgctgtcgtagtcgccgccgccgctgccggagaaagagcacgagcggggaagccccagagtgaaatctagcatcctgccggctggtctgcccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggagctggaggagggaatgatattcagtggtgtttttctcaggtgaaaggagcagtagatgatgatgtagcagaagcagatataatttctacagtagaatttaatcattctggagaattactagcaacaggagataaaggtggtagagttgtcatctttcaacaggagcaggagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatgataaaacaataaaattatggaaaatcagtgaaagggacaaaagaccagaagggtataacttgaaagaggaggatggaaggtatagagatcctactacagttactacactacgagtgccagtctttaggcctatggatctaatggttgaggccagtccacgaagaatatttgccaatgctcatacatatcacatcaactcaatttctattaatagtgattatgaaacatatttatctgcagatgatttgcggattaatctttggcatctggaaattacagacaggagttttaacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaattgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtgcatgaatacctcagaagtaaactctgttcactgtatgaaaatgactgcatatttgacaaatttgaatgttgttggaatggatctgacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatggaaaaaaaaaaaaaaaaaaaaaaa

SEQ ID NO: 292 - DNA, 2808 bp, Homo sapiens
cggcatgagaggccagcctgccagggaaatccaggaatctgcaacaaaaacgatgacagtctgaaatactctctggtgccaacctccaaattctcgtctgtcacttcagacccccactagttgacagagcagcagaatatcaactccagtagacttgaatgtgcctctgggcaaagaagcagagctaacgaggaaagggatttaaagagtttttcttgggtgtttgtcaaacttttattccctgtctgtgtgcagaggggattcaacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacatgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaaaaaaaaaaaaaaaaaaaaaaaaaaaaaaaaaaaaaaaaaaaaaaaaaaaaa

SEQ ID NO: 293 - DNA, 1184 bp, Homo sapiens
cgtgcggcggcatctccgtgtccctgtgactcgagaccgcggctgtcgggtctccccctctctgaccctgcgtctctgtccccgctgtgtccgccctctctccgtgactctgtgtgtctctcgctgtcttgctgtggctgtcactcccaggctgtctcccagtacttcctggactctacctcggaaacttcattgatgccaaagacctggatcagctgggccgaaataagatcacacacatcatctctatccatgagtcaccccagcctctgctgcaggatatcacctaccttcgcatcccggtcgctgatacccctgaggtacccatcaaaaagcacttcaaagaatgtatcaacttcatccactgctgccgccttaatggggggaactgccttgtgcactgctttgcaggcatctctcgcagcaccacgattgtgacagcgtatgtgatgactgtgacggggctaggctggcgggacgtgcttgaagccatcaaggccaccaggcccatcgccaaccccaacccaggctttaggcagcagcttgaagagtttggctgggccagttcccagaagcttcgccggcagctggaggagcgcttcggcgagagccccttccgcgacgaggaggagttgcgcgcgctgctgccgctgtgcaagcgctgccggcagggctccgcgacctcggcctcctccgccgggccgcactcagcagcctccgagggaaccgtgcagcgcctggtgccgcgcacgccccgggaagcccaccggccgctgccgctgctggcgcgcgtcaagcagactttctcttgcctcccccggtgtctgtcccgcaagggcggcaagtgaggatgcagtccagccgtggctccccacttccgactggctcccttcgggggctgtctgcgccttccacgccccccaggacgggcccagaggctgggggagccccgcggcggcctgaaccctgcctcccgcgcccgccctgctcgtccgcgtctgcagtcagcgtccccaacctgtgcgtctctgtgtccgggccggcctgctgcagccacctggtgccttagtccttgggctgggggagggggcccacccttaaaggcggcgggaggggagggagggagagtggagggtttgacgggcctggagggtattaaagagacacagaagaagctgcctgtc

SEQ ID NO: 294 - DNA, 4485 bp, Homo sapiens
gtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagctctattcaacaacaaattgactgacggctgtgcacactccatggctaagctccttgcatgcaggcagaacttcttggcattgaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaac

SEQ ID NO: 295 - DNA, 1577 bp, Homo sapiens
attcggcacaggcgtccgctgcagtccgccggcgagggagttacgcacgtcctgattctcctggagtctccagcccgcccagtggccgcagtcacccaggtccagaggcggcggtatcacaggctctccgacatgtctatgctggctgaacgtcggcggaagcagaagtgggctgtggatcctcagaacactgcctggagtaatgacgattccaagtttggccagcggatgctagagaagatggggtggtctaaaggaaagggtttaggggctcaggagcaaggagccacagatcatattaaagttcaagtgaaaaataaccacctgggactcggagctaccatcaataatgaagacaactggattgcccatcaggatgattttaaccagcttctggccgaactgaacacttgccatgggcaggaaaccacagattcctcggacaagaaggaaaagaaatcttttagccttgaggaaaagtccaaaatctccaaaaaccgtgttcactatatgaaattcacaaaagggaaggatctgtcatctcggagcaaaacagatcttgactgcatttttgggaaaagacagagtaagaagactcccgagggcgatgccagtccctccactccagaggagaacgaaaccacgacaaccagcgccttcaccatccaggagtactttgccaagcggatggcagcactgaagaacaagccccaggttccagttccagggtctgacatttctgtgacgcaggtagaacgtaaaagggggaagaaaagaaataaagaggccacaggtaaagatgtggaaagttacctccagcctaaggccaagaggcacacggagggaaagcccgagagggccgaggcccaggagcgagtggccaagaagaagagcgcgccagcagaagagcagctcagaggcccctgctgggaccagagttccaaggcctctgctcaggatgcaggggaccatgtgcagccgcctgagggccgggacttcaccctgaagcccaaaaagaggagagggaagaaaaagctgcaaaaaccagtagagatagcagaggacgctacactagaagaaacgctagtgaaaaagaagaagaagaaagattccaaatgaatccttcccagccggggccttccgaccactcagctgtcagggcactgcgggggcagacacctctggcctgaagtcacagcagagttcaccccagagcgcctgggcgcatcttgtggcatgcccatgggctgccgagtcctgccctctcgccacatttcccccaagttacattcccaggaggacctttttaatgttctcaatcgtggctctcagacacaaataaatttttttgtaaactctgagcccttcagcaagagagtttaattataatcattacaaatacatgcattcatgtaagtgtgcacacgtgtgtgtgcatgtgcgcatctgtgtgtgtgtgtgtgtgtcactatctccgtttgctctcggttcccttcaataacaatgaatggtgctttcttctgaaagactcagcctaattaaaggatttagaggcaaaaaaaaaaaaaaaaaaaaaa

SEQ ID NO: 296 - DNA, 3076 bp, Homo sapiens; identical to SEQ ID NO: 156

SEQ ID NO: 297 - DNA, 2311 bp, Homo sapiens
tagccagaaaagggggcgggaagggctgtagggtacttgtcaattcgccgccatgaacgtggtttttgctgtgaagcagtacatttccaaaatgatagaggacagcgggcctggtatgaaagtacttctcatggataaagagacgactggcatagtgagtatggtatacacacaatcggagattctacagaaggaagtgtacctctttgaacgcattgattctcaaaatcgagagatcatgaaacacctgaaggcaatttgttttcttcgacctacaaaggagaatgtggattatattattcaggagctccgaagacccaaatacactatatatttcatttatttcagtaatgtgatcagcaagagtgacgtgaagtcattggctgaagctgatgaacaggaagttgtggctgaggttcaggaattttatggtgattacattgctgtgaacccacatttgttttccctcaatattttgggttgctgccagggtcgaaattgggatccagcccagctatctagaacaactcaagggcttacagctctccttttatctctgaagaagtgtcccatgattcgttatcagctctcatcagaggcagcaaagagacttgcagagtgcgttaagcaagtgataactaaagaatatgaactgtttgaattccgtcggacagaggttcctccattgctccttattttagatcgctgtgatgatgccatcaccccattgctaaaccagtggacatatcaggccatggtccacgaactactaggcataaacaacaatcggattgatctttccagagtgccgggaatcagtaaagacttaagagaagtggtcctatctgctgaaaatgatgaattctatgctaataatatgtacctgaactttgctgagattggtagcaatataaagaatctcatggaagattttcagaagaagaaaccaaaagaacagcaaaaactagaatcaatagcagacatgaaggcgtttgttgagaattatccacagttcaagaaaatgtctgggactgtttcaaagcatgtgacagtggttggagaactgtctcgattggtcagtgaacggaatctgctggaggtttcagaggttgagcaagaactggcctgtcaaaatgaccattctagtgctctccagaatataaaaaggcttctgcagaaccccaaagtgacagagtttgatgctgcccgcctggtgatgctttatgctttacattatgagcgacacagcagcaatagcctgccaggactaatgatggacctcaggaataaaggtgtttctgagaagtatcgaaagctcgtgtctgcagttgttgaatatggtggtaaacgagtcagaggaagtgacctcttcagccccaaagatgctgtggctatcaccaaacaattcctcaaaggactgaagggagtagaaaatgtatatacacagcatcaacctttcctacatgaaaccctggatcatctcatcaaaggaaggcttaaggaaaacctatatccttatttaggccccagcacactcagagacagacctcaggatatcattgtgtttgtaattggaggagccacctatgaagaggctctaacagtttataacctgaaccgcaccactcctggagtgaggattgtcctgggaggcaccacagtgcacaacacgaaaagtttcctagaggaagttctggcttctggactgcacagccgaagcaaggagagctctcaagtcacatcaaggtcagcgagcagaagatgaaacggtggttgggggaagggcacagcttcctctcttgtccccactacaggttttccctactaaacaaaggtgttggagagcagctttgggttctgtgctggttgttagaactcatctccaggtagcccacggatacgtggttggcacagacacaagactcccagagttgtcctaacaataagtctgagcccatctcaacccacttttctccggtagtctttatgtatctgttagcacaatcacttcagttactgatgaattttgttgggatctgacttggggaaagggttatcagagcctagaggggcttaaaaagtaatcatttgatgtacataccacactccttggcttcctttctcttcccttaaccctttctgcttttcattaaccacattcctgcacaactcatttctgaaaacctaccatgtttctttacagagccatccaaaaattttttgtccctacatagcaattttctgtggcactgagaaaccatgtatgaccacaataaaaatccattttgtgaaaggaaaaaaaaaaaaaaaa

SEQ ID NO: 298 - DNA, 5064 bp, Homo sapiens
gagaaggggaccttcaggtccaggcaaagggggaacttctgtcgtgggaacgaaaaagaaagaggatttacagggtggggggacagaggggcagcaggaaccagaagggagacagtggcggtcgcaccggggccgatccgagagttccccttagagaacggagctcacgggcggggaggcctcacctgctagtaggacgcagaaagacagaaggcgaaggagaccccctgccgtagccatcttgcctctctgctgagcggaagcccccgttcggctcctgtctgttagcggcctctctaggctaccactgacaccgtctctgtggcccggagcctaagagaccggaagttcgtgtttccaggcgcttccggaaaccgcgggagagggtcgctgacgtggaggcgtccgaagggcagcagggtgtgtcggggctcggattaagacatcggagtcggagacctgagagatgttaaccaaattcgagaccaagagcgcgcgggtcaaagggctcagctttcaccccaaaagaccttggatcctgactagtttacataatggggtcatccagttatgggactatcggatgtgcactctcattgacaagtttgatgaacatgatggtccagtgcgaggcattgacttccataagcagcagccactgttcgtctctggaggagatgactataagattaaggtttggaattacaagcttcggcgctgtcttttcacattgcttgggcacttagattatattcgcaccacgttttttcatcatgaatatccctggattctgagtgcctccgatgatcagaccatccgagtgtggaattggcaatctagaacctgtgtttgtgtgttaacagggcacaaccattatgtgatgtgtgctcagttccaccccacagaagacttggtagtatcagccagcctggaccagactgtgcgcgtttgggatatttctggtctgaggaaaaaaaacctgtcccctggtgcggtggaatcggatgtgagaggaataactggggttgatctatttggaactacagatgcagtggtgaagcatgtactagagggtcacgatcgtggagtaaactgggctgccttccaccccactatgccccttattgtatctggggcagatgatcgtcaagtgaagatctggcgcatgaatgaatcaaaggcatgggaggttgatacctgccggggccattacaacaatgtatcttgtgccgtcttccaccctcgccaagagttgatcctcagcaattctgaggacaagagtattcgagtctgggatatgtctaagcggactggggttcagactttccgcagagaccatgatcgtttctgggtcctagctgctcaccctaaccttaacctctttgcagcaggccatgatggtggtatgattgtgtttaagctggaacgggaacggccagcctatgctgttcatggcaatatgctacactatgtcaaggaccgattcttacgacagctggatttcaacagctccaaagatgtagctgtgatgcagttgcggagtggttccaagtttccagtattcaatatgtcatacaatccagcagaaaatgcagtcctgctttgtacaagagctagcaatctagagaatagtacctatgacctgtacaccatccctaaagatgctgactcccagaatcctgatgcgcctgaagggaaacgatcctcaggcctgacagccgtttgggtcgctcgaaatcggtttgctgtcctagatcggatgcattcgcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggactctggcatctgtgaagatttctaaagtgaaatacgttatctggtcagcagacatgtcacatgtagcactactagccaaacacgccattgtgatctgtaaccgcaaactggatgctttatgtaacattcatgagaacattcgtgtcaagagtggggcctgggatgagagtggggtatttatctataccacaagcaaccacatcaaatatgctgtcaccactggggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgagattgctctggaagcagccaaagcactggatgacaagaactgctgggaaaagctgggagaagtggccctgctgcaggggaaccaccagattgtggaaatgtgctatcagcgtaccaaaaactttgacaaagtttccttcctgtatcttatcactggcaacttagaaaaacttcgcaagatgatgaagattgctgagatcagaaaggacatgagtggccactatcagaatgccctatacctgggtgatgtgtcagagcgtgtgcggatcctgaagaactgtggacagaagtccctggcctatctcacagctgctacccatggcttagatgaagaagctgagagcctaaaggagacatttgacccagagaaggagacaatcccagacattgaccctaatgccaagctgctccagccacctgcacctatcatgccattggataccaattggcctttattgactgtatccaaaggattttttgaaggcaccattgccagcaaagggaagggaggagcactggctgctgacattgacattgacactgttggtacagagggctggggagaggatgcagagctgcagttggatgaagatgggtttgtggaggctacagaaggtttgggggatgatgctcttggcaagggacaggaagaaggaggtggctgggatgtagaagaagatctggagctccctcctgagctggatatatcccctggggcagctggtggggctgaagatggtttctttgtgcccccaaccaagggaacaagtccaactcagatctggtgtaataactctcagcttccagttgatcacatcctggcaggctctttcgaaacagccatgcggctccttcatgaccaagtaggggtaatccagtttggcccctacaagcaactgttcctacagacatacgcccgaggccgcacaacctatcaggctctgccctgcctaccctccatgtatggctatcctaatcgcaactggaaggatgcagggctgaagaatggtgtaccagctgtgggcctgaagcttaatgacctcatccaacggttgcagctgtgctaccagctcaccacagttggcaaatttgaggaggctgtggaaaaattccgttccatccttctcagtgtgccacttcttgttgtggacaataaacaagagattgcagaggcccagcagctcatcaccatttgccgtgagtacattgtgggtttgtccgtggagacagaaaggaagaagctgcccaaagagactctagaacagcagaagcgcatctgtgagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacagacccgaaaaatcctgtctgcctgtgagaagaatcccacagatgcctaccagctcaattatgacatgcacaacccctttgacatttgtgctgcatcatatcggcccatctaccgtggaaagccagtagaaaagtgtccactcagtggggcctgctattcccctgagttcaaaggtcaaatctgcagggtcaccacagtgacagagattggcaaagatgtgattggtttaaggatcagtcctctgcagtttcgctaaggccccctttgtgtgcatgggtcagtcaccatatgttccccccagagaatgtgtctatatcctccttctaacagcaccttccccctgcagctactcttcagatctggctctctgtaccctaaaacctagtatctttttctcttctatggaaaatccgaaggtctaaacttgacttttttgaggtcttctcaacttgactacagttgtgctcataattgtccttgcctttccagcttaattattttaaggaacaaatgaaaactctgggctgggtggagtggctcatacctgtaatcccagcactttgggaggctacggtgggcagatcatctgaggccaggagttcgagacctgcctggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaaaaaaaaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgaaaaaaaaaaaaaaaaagcg

SEQ ID NO: 299 - DNA, 1235 bp, Homo sapiens
tgagaagggaggtgaccaccaggactggctctgtgagtaccacacagtgggagggggtgggggccacatgtcatcatatcagaaggaactggagaaatacagagacatagatgaagatgagatcctaaggaccttgagccccgaggagctagagcagctggactgcgaactacaggagatggatcctgagaacatgctcctgccagctggactaagacaacgtgaccagacaaagaagagcccaacggggccactggaccgagaggcccttttgcagtacttggagcaacaggcactagaagtcaaagagcgtgatgacttggtgcccttcacaggcgagaagaaggggaaaccctatattcagcccaagagggaaatcccagcagaggagcagatcaccctggagcctgagctggaggaggcactggcacatgccacagatgctgaaatgtgtgacattgcagcaattctggacatgtacacactgatgagtaacaagcaatactatgatgccctctgcagtggagaaatctgcaacactgaaggcattagcagtgtggtacagcctgacaagtataagccagtgccggatgaacccccaaatcccacaaacattgaggagatactaaagagggtccgaagcaatgacaaggagctggaggaggtgaacttgaataatatacaggacatcccaatacccatgctaagtgagctgtgtgaggcaatgaaggcaaatacctatgtgcggagcttcagtctggtagccacgaggagtggtgaccccattgccaatgcagtggctgacatgttgcgtgagaatcgtagcctccagagcctaaacatcgaatccaacttcattagcagcacaggactcatggctgtgctgaaggcagttcgggaaaatgccacactcattgagctccgtgtagacaatcagcgccagtggcctggtgatgcagtggagatggagatggccaccgtgctagagcagtgtccctctattgtccgctttggctaccactttacacagcaggggccacgagctcgggcagcccaggccatgacccgaaacaatgaactacgtcgccagcaaaagaagagataacactgcatttccctttaccaactagcgctgggagcactggacacttaaatcctcatctgtcctcctttcctgtaaataaaagcccttctatccaaaaaaaaaaaaaaaaaaaaaaaaaaaaaaaaaaaaa

SEQ ID NO: 300 - DNA, 1981 bp, Homo sapiens
ctgctcagtgtcaaattaacaggaaagtcagcttaaaggacactccttgcagggactgagctggcacctactccttagagcttgctgataccaggcctgccacgcgacatctgcaaggacagttgtttggtgttttgcttcaggttatagatggagagacctataaaggactccatgttttcgttggccctgaaatgccttatcagtctgtccaccatcatccttttgggcttgatcatcgcctaccacacacgtgaagtccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtaccatgaccagcaggacgtaactagtaactttctgggtgccatgtggctcatctccatcacattcctttccattggttatggggacatggtgccccacacatactgtgggaaaggtgtctgtctcctcactggcatcatgggtgcaggctgcactgcccttgtggtggccgtggtggcccgaaagctggaactcaccaaagcggagaagcacgttcataacttcatgatggacactcagctcaccaagcggatcaagaatgctgcagccaatgtccttcgggaaacatggttaatctataaacacacaaagctgctaaagaagattgaccatgccaaagtgaggaaacaccagaggaagttcctccaagctatccaccagttgaggagcgtcaagatggaacagaggaagctgagtgaccaagccaacactctggtggacctttccaagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaa

SEQ ID NO: 301 - DNA, 3209 bp, Homo sapiens
attcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggacccagccagggggtgggctctagagcgagtggggtggagaggagaaaggacggggccttgggcgcctctgagatgctcccaagtgccagggagggccgagcgaggcgcaggcaaccgggcagcaggcatgatgccctcgcctagtgactccagccgctcgctgaccagccggcccagcaccaggggccttacccacctccgcctccaccgaccctggctgcaggccctgcttacgctggggctggtccaagtgctcctgggcatcctggtggtcaccttcagcatggtggcctcttccgtcaccaccaccgagagcatcaagaggtcctgcccgtcttgggctgggttctcgctggcgttctccggggtggttggcattgtgtcctggaagcggccattcactctagtgatctccttcttctccttgctttcggtgctctgtgtcatgcttagcatggctggctctgttctctcctgtaagaatgctcaactggcccgagacttccaacagtgctctctggaaggaaaggtctgtgtgtgctgtccctctgttcccctcctccggccctgtccagagtcggggcaggaactgaaagttgcccctaactccacctgtgatgaagcccgaggggccctcaagaacctgctcttcagcgtctgtgggctcaccatttgtgccgctataatctgtacactctctgctattgtctgctgcatccaaatcttctccctggacctcgtgcatacgctggcccctgagcggtcagtctcaggcccactgggacctctgggctgcacgtccccgcccccagcccctctcctacacaccatgctggacctggaggaatttgtcccgcctgtgcccccaccgccctactatcccccagagtatacctgcagctcagaaacagatgcacagagcatcacgtacaatggctccatggacagcccagtgcccttgtaccctaccgattgccccccttcttatgaggcagtcatgggactacgaggagacagccaggccactctctttgaccctcagcttcacgatggctcgtgcatctgtgaacgagtggcctccattgtagacgtgtccatggacagcgggtctctggtgctgtcagccattggtgacctccctgggggctctagcccgtcggaggactcgtgcctgctggagctgcagggctccgtgcgctccgtggactacgttctctttcgctccatccagcgcagccgtgccggctactgcctcagcctggactgtggcctgcggggccccttcgaggaaagccccctgccacggcgccccccacgggctgcccgctcctattcctgctctgcccctgaagctccacccccactgggtgcccccacagctgcccgcagctgccaccggttggagggctggccgccctgggtgggaccctgcttccccgagctgaggcggcgggtcccccggggagggggccgcccagccgcagccccgcccacccgagccccgactcgtcgcttcagcgatagctcaggttccctcaccccaccggggcaccggcctcctcatccggcatccccaccaccgctgctgctgccacggtcccacagcgacccaggcatcacgacctccagtgacactgctgacttcagggacctttataccaaagtgcttgaggaagaagctgcttctgtttcctctgcagatacagggctctgctctgaagcctgcctcttccgcctagcccgctgcccttcccccaagttgctacgtgcccggtcagccgagaaacggcgccctgtgcccaccttccaaaaagttcccctgccctcgggccctgcacctgcccactccctgggggacctaaagggcagctggccaggtcggggcctggtcactcgtttcctccagatatccaggaaagccccagaccccagtgggactggagctcatggacataagcaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatcaaaaaaaaaaaaaaaaaaaa

SEQ ID NO: 302 - DNA, 1345 bp, Homo sapiens
ggaacaggatgcccctgtcccgctggttgagatctgtgggggtcttcctgctgccagccccctactgggcaccccgggagaggtggctgggttccctacggcggccctccctggtgcacgggtacccagtcctggcctggcacagtgcccgctgctggtgccaagcgtggacagaggaacctcgagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcagagttcctatcagactgagattgggcagaccctggacctcctcacagccccccagggcaatgtggatcttgtcagattcactgaaaagaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaaaaaaaaaaa

SEQ ID NO: 303 - DNA, 5591 bp, Homo sapiens
gctactcccaccccgccccgccccgtcattgtccccgtcggtctcttttctcttccgtcctaaaagctctgcgagccgctcccttctcccggtgccccgcgtctgtccatcctcagtgggtcagacgagcaggatggagggctgcatgggggaggagtcgtttcagatgtgggagctcaatcggcgcctggaggcctacctggcccgggtcaaggcgctggaggagcagaatgagctgctcagcgcggagctcggggggctccgggcacaatccgcggacacctcctggcgggcgcatgccgacgacgagctggcggccctgcgggccctcgttgaccaacgctggcgggagaagcacgcggccgaggtggcgcgcgacaacctggctgaagagctggagggcgtggcaggccgatgccagcagctgcggctggcccgggagcggacgacggaggaggtagcccgcaaccggcgcgccgtcgaggcagagaaatgcgcccgggcctggctgagtagccaggtggcagagctggagcgcgagctagaggctctacgcgtggcgcacgaggaggagcgcgtcggcctgaacgcgcaggctgcctgtgccccccgctgccccgcgccgccccgcgggcctcccgcgccggccccggaggtagaggagctggcaaggcgactgggcgaggcgtggcgcggggcagtgcgcggctaccaggagcgcgtggcacacatggagacgtcgctgggccaggcccgcgagcggctgggccgggcggtgcagggtgcccgcgagggccgcctggagctgcagcagctccaggctgagcgcggaggcctcctggagcgcagggcagcgttggaacagaggttggagggccgctggcaggagcggctgcgggctactgaaaagttccagctggctgtggaggccctggagcaggagaaacagggcctacagagccagatcgctcaggtcctggaaggtcggcagcagctggcgcacctcaagatgtccctcagcctggaggtggccacgtacaggaccctcctggaggctgagaactcccggctgcaaacacctggcggtggctccaagacttccctcagctttcaggaccccaagctggagctgcaattccctaggaccccagagggccggcgtcttggatctttgctcccagtcctgagcccaacttccctcccctcacccttgcctgctacccttgagacacctgtgccagcctttcttaagaaccaagaattcctccaggcccgtacccctaccttggccagcacccccatcccccccacacctcaggcaccctctcctgctgtagatgcagagatcagagcccaggatgctcctctctctctgctccagacacagggtgggaggaaacaggctccagagcccctgcgggctgaagccagggtggccattcctgccagcgtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctcaaggggagactggaaaggagggctgggatcctgctgtcctggcttccgagggccttgaggccccaccctcagaaaaggaggagggggaggagggagaagaggagtgtggccgtgactctgacctgtcagaagaatttgaggacctggggactgaggcaccttttcttcctggggtccctggggaggtggcagaacctctgggccaggtgccccagctgctactggatcctgcagcctgggatcgagatggggagtccgatgggtttgcagatgaggaagaaagtggggaggagggagaggaggatcaggaggaggggagggagccaggggctgggcggtgggggccagggtcttctgttggcagcctccaggccctgagtagctcccagagaggggaattcctggagtctgattctgtgagtgtcagtgtcccctgggatgacagcttgaggggtgcagtggctggtgcccccaagactgccctggaaacggagtcccaggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaaaaaaaaaaaaaaaaaaaaaaaaaaaaaaaaaaa

SEQ ID NO: 304 - DNA, 470 bp, Homo sapiens
gggaccgctataaggccagtcggactgcgacatagcccatcccctcgaccgctcgcgtcgcatttggccgcctccctaccgctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcgaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacacctctgggggtcctctctgagtcaaatccagtggtgggtaattgtacaataaattttttttggtcaaattt

SEQ ID NO: 305 - DNA, 2226 bp, Homo sapiens
ggcagcatggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtaacaataaattactaccagtcaaaaaaaaaaaaaaaaaaaaaaaaaaaaaaaaaaaaaaaaaaaaaaaaa

SEQ ID NO: 306 - DNA, 2074 bp, Homo sapiens
tagggggtggccctgaactggggcctggccctggctggcctctcccgccgcctcactgggggacaggtccagcctgtggtgtccacaatgccccaggcctctgagcaccgcctgggccgtacccgagagccacctgttaatatccagccccgagtgggatccaagctaccatttgcccccagggcccgcagcaaggagcgcagaaacccagcctctgggccaaaccccatgttacgacctctgcctccccggccaggtctgcctgatgaacggctcaagaaactggagctgggacggggacggacctcaggccctcgtcccagaggcccccttcgagcagatcatggggttcccctgcctggctcaccacccccaacagtggctttgcctctcccatctcggaccaacttagcccgttccaagtctgtgagcagtggggacttgcgtccaatggggattgccttgggagggcaccgtggcaccggagagcttggggctgcactgagccgcttggccctccggcctgagccacccactttgagacgtagcacttctctccgccgcctagggggctttcctggaccccctaccctgttcagcatacggacagagccccctgcttcccatggctccttccacatgatatccgcccggtcctctgagcctttctactctgatgacaagatggctcatcacacactccttctgggctctggtcatgttggccttcgaaacctgggaaacacgtgcttcctgaatgctgtgctgcagtgtctgagcagcactcgacctcttcgggacttctgtctgagaagggacttccggcaagaggtgcctggaggaggccgagcccaagagctcactgaagcctttgcagatgtgattggtgccctctggcaccctgactcctgcgaagctgtgaatcctactcgattccgagctgtcttccagaaatatgttccctccttctctggatacagccagcaggatgcccaagagttcctgaagctcctcatggagcggctacaccttgaaatcaaccgccgaggccgccgggctccaccgatacttgccaatggtccagttccctctccaccccgccgaggaggggctctgctagaagaacctgagttaagtgatgatgaccgagccaacctaatgtggaaacgttacctggagcgagaggacagcaagattgtggacctgtttgtgggccagttgaaaagttgtctcaagtgccaggcctgtgggtatcgctccacgaccttcgaggttttttgtgacctgtccctgcccatccccaagaaaggatttgctgggggcaaggtgtctctgcgggattgtttcaaccttttcactaaggaagaagagctagagtcggagaatgccccagtgtgtgaccgatgtcggcagaaaactcgaagtaccaaaaagttgacagtacaaagattccctcgaatcctcgtgctccatctgaatcgattttctgcctcccgaggctccatcaaaaaaagttcagtaggtgtagactttccactgcagcgactgagcctaggggactttgccagtgacaaagccggaagtcctgtataccagctgtatgccctttgcaaccactcaggcagcgtccactatggccactacacagccctgtgccggtgccagactggttggcatgtctacaatgactctcgtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggaggggggagggggtggttgtagctccattattttttttattaaaaaatacccttccacctggaggctcccttgtctcccagccccatgtacaaagctcaccaagcccctgcccatgtacagcccccagaccctctgcaatatcactttttgtgaataaatttattaagaaaaaaaaaaaaaaaaaaa

SEQ ID NO: 307 - DNA, 1207 bp, Homo sapiens
acagagatcagcaaacagcttttctgagagaaagaaacatctgcaaatgacatgctgtttctgcagtttctgctgctagctcttcttctcccaggtggtgacaatgcagacgcatcccaggaacacgtctccttccatgtcatccagatcttctcatttgtcaaccaatcctgggcacgaggtcagggctcaggatggctggacgagttgcagactcatggctgggacagtgaatcaggcacaataattttcctgcataactggtccaagggcaacttcagcaatgaagagttgtcagacctagagttgttatttcgtttctacctctttggattaactcgggagattcaagaccatgcaagtcaagattactcgaaatatccctttgaagtacaggtgaaagcgggctgtgagctgcattctggaaagagcccagaaggcttctttcaggtagctttcaacggattagatttactgagtttccagaatacaacatgggtgccatctccaggctgtggaagtttggcccaaagtgtctgtcatctactcaatcatcagtatgaaggcgtcacagaaacagtgtataatctcataagaagcacttgcccccgatttctcttgggtctcctggatgcagggaagatgtatgtacacaggcaagtgaggccagaagcctggctgtccagtcgccccagccttgggtctggccagctgttgctggtttgtcatgcctccggcttctacccaaagcctgtttgggtgacatggatgcggaatgaacaggagcaactgggcactaaacatggtgatattcttcctaatgctgatgggacatggtatcttcaggtgatcctggaggtggcatctgaggagcctgctggcctgtcttgtcgagtgagacacagcagtctaggaggccaggacatcatcctctactggggacaccactcttccatgaattggattgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaacatttgttaataaaaaccaaaaaaaaaaaaaaaa

SEQ ID NO: 308 - DNA, 2142 bp, Homo sapiens
ggaagttgtagttcctgtattggtgaggcaaggaggaggcggagtgactcggcggccattagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcggggcctactaggcctccgggcatccccggtctcaagtaggcctcatctgccggcaagggcgcccgaaacgcgggaggcgccatgtcgctggttgcttacgccagcagcgatgagagcgagccggatgaggctgagcccgagccggaggaagaggaggcggtggctcctacatctgggcccgctttagggggcttgttcgcttctctccctgcgcccaagggtccggccttgctgcctccgccccctcagatgctggcgccagcctttcccccgccgctgttgcttcccccacccaccggagaccccaggcttcagcctcctccccccttgcccttcggcctgggaggcttccccccacctccaggcgtgagcccggctgaagcggcgggagttggggagggactgggattggggttgccctcgccccgaggccctggcctcaatctgccccctccaattggcggtgccggtcccccgctggggcttcccaagccaaagaagaggaaagagcccgtgaagatcgcggcgccggagttgcataagggagattcagattctgaggaagatgaacccacaaagaagaaaactatccttcagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggattattacagtggtggctactatcctgcacaggacccggccctggtccccccccaggaaattgccccagatgcctccttcatcgatgacgaagcatttaagcggctgcagggcaagaggaaccgagggagagaagaaatcaactttgtggagatcaaaggtgatgaccagctcagtggggcccagcaatggatgactaagtcattgacagaagagaaaaccatgaagtcattcagcaaaaagaaaggtgagcagccaacaggccagcagcggcggaaacaccagatcacatatcttattcatcaggccaaggagcgggagctggaactgaagaacacctggtcagagaacaagctcagccgccgtcagacccaagccaaatatggattctagggctctggaactgattgctcccaggatctcctgccagcccagctggcctggcccccagcttcacctctgggaccccagctgctctaagcccaggatctctttccccaaggacccagccctcgcctctgcgagaatgaacatatttgatagatttttcttaacaagttagaaaattcagctcctttctgtcctggagctagcaaagacttgtgtgatgcctccgaaggggctctgagttctggggtgggagttttgctctctgtcaggtgtgataaaatgttgaaccctccccaccaccacttttttttttttaaaccagggatgtctgttgaaataaaacattcagtctgacaaacaaaaaaaaaaaaaaaaaaaa

SEQ ID NO: 309 - DNA, 595 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaatacagaactagctgccttcacaaagaaccagaaggaccctggtgtccttgaccgcatgatgaagaaactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcaggccccacctgccaatagtaataaagcaatgtcacttttttaaaacatgaaa

SEQ ID NO: 310 - DNA, 970 bp, Homo sapiens
ctcccctcaccccggtccaggatgcccagtccccacgacacctcccacttcccactgtggcctgggtgggctcaggggctgcccttgacctggcctagagccctcccccagctggtggtggagctggcactctctgggagggagggggctgggagggaatgagtgggaatggcaagaggccagggtttggtgggatcaggttgaggcaggtttggtttccttaaaatgccaagttgggggccagtggggcccacatataaatcctcaccctgggagcctggctgccttgctctccttcctgggtctgtctctgccacctggtctgccacagatccatgatgtgcagttctctggagcaggcgctggctgtgctggtcactaccttccacaagtactcctgccaagagggcgacaagttcaagctgagtaagggggaaatgaaggaacttctgcacaaggagctgcccagctttgtgggggagaaagtggatgaggaggggctgaagaagctgatgggcagcctggatgagaacagtgaccagcaggtggacttccaggagtatgctgttttcctggcactcatcactgtcatgtgcaatgacttcttccagggctgcccagaccgaccctgaagcagaactcttgacttcctgccatggatctcttgggcccaggactgttgatgcctttgagttttgtattcaataaactttttttgtctgttgataatattttaattgctcagtgatgttccataacccggctggctcagctggagtgctgggagatgagggcctcctggatcctgctcccttctgggctctgactctcctggaaatctctccaaggccagagctatgctttaggtctcaattttggaatttcaaacaccagcaaaaaattggaaatcgagataggttgctgacttttattttgtcaaataaagatattaaaaaaggcaaaaaaaaaa

SEQ ID NO: 311 - DNA, 2055 bp, Homo sapiens
ggagcgaaggtaggaggcagggcttgcctcactggccaccctcccaaccccaagagcccagccccatggtccccgccgccggcgcgctgctgtgggtcctgctgctgaatctgggtccccgggcggcgggggcccaaggcctgacccagactccgaccgaaatgcagcgggtcagtttacgctttgggggccccatgacccgcagctaccggagcaccgcccggactggtcttccccggaagacaaggataatcctagaggacgagaatgatgccatggccgacgccgaccgcctggctggaccagcggctgccgagctcttggccgccacggtgtccaccggctttagccggtcgtccgccattaacgaggaggatgggtcttcagaagagggggttgtgattaatgccggaaaggatagcaccagcagagagcttcccagtgcgactcccaatacagcggggagttccagcacgaggtttatagccaatagtcaggagcctgaaatcaggctgacttcaagcctgccgcgctcccccgggaggtctactgaggacctgccaggctcgcaggccaccctgagccagtggtccacacctgggtctaccccgagccggtggccgtcaccctcacccacagccatgccatctcctgaggatctgcggctggtgctgatgccctggggcccgtggcactgccactgcaagtcgggcaccatgagccggagccggtctgggaagctgcacggcctttccgggcgccttcgagttggggcgctgagccagctccgcacggagcacaagccttgcacctatcaacaatgtccctgcaaccgacttcgggaagagtgccccctggacacaagtctctgtactgacaccaactgtgcctctcagagcaccaccagtaccaggaccaccactacccccttccccaccatccacctcagaagcagtcccagcctgccacccgccagcccctgcccagccctggctttttggaaacgggtcaggattggcctggaggatatttggaatagcctctcttcagtgttcacagagatgcaaccaatagacagaaaccagaggtaatggccacttcatccacatgaggagatgtcagtatctcaacctctcttgccctttcaatcctagcacccactagatatttttagtacagaaaaacaaaactggaaaacacattgtttggtcttgtgtttctttacagaggtacctgagggaggagagacataaatcccttcatccctaagactgaactatgtaactagcagcctctggcttgttttctactccctgtccctcaggataaaatgttgatattgctcattttcctcatttccaacattgttttaaaacaagtacttcttttacaggcttgaaaaatctcaaataaacgctaagaaaagggagtaggaagaacaaggagttgagcccttgaaagatgacagtggtcttcttgccttcatgcttggccctctctcctcaaaagggcaatgttggtacaaaattccatctcagccactttcgaggagttatcttcattagctatatccatcctttaatccaacacacacctgcaatgattactgtgcaactattttgcttaattttttatttgaaaaaatgtatttaaaagtccaacaactttttaatataaattacgactctcaaacccattcccatcactttattagtgatggtagcatacatattagagaaggtagctaaaggcaagagagcaccaaaggaaaaagactgtccaaagaacaggtattagaatgaggccgaagatcacggtgaccagagatttctaggagtctctaacctttccaccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaaaaaaaaaaaaaaaaaaaaaaaaaa

SEQ ID NO: 312 - DNA, 625 bp, Homo sapiens
ggacgtgtctgtgctcctgcgtgtgaccagggttgactaaactctgccaggatgtcttgccagcaaaaccagcagcagtgccagccccctcccaagtgtcctcccaagtgtaccccaaaatgtccacctaagtgtccccctaaatgcctgccccagtgcccagctccatgttcccctgcagtctcttcttgctgtggtcccatctctgggggctgctgtggtcccagctctgggggctgctgcaactctggggctggtggctgctgcctgagccaccacaggccccgtctcttccaccggcgccggcaccagagccccgactgctgtgagagtgaaccttctgggggctctggctgctgccacagctctgggggctgctgctgacctgggctaagaagaactctttggacagaatgtttaagaacctcctacagcctgatgcttaaccctttccatttcctctcattccattcatgggtggacagcgaccacaaagactcatggggcttccctgggagaactttgcacttgatggagcacctcaattgcaggttttgttttcctcctttacctcatgtttgttaataaactctgtttctgactctcaaaaaaaaaaaaaaaaaaa

SEQ ID NO: 313 - DNA, 5392 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtacctcgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccatcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtccggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagccctccagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtgattgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaacggaagagaaggagcttggatgaggaaactgttcagcaagaggaagggcttctcacactttcatgtgcttgtggatcacctgaggatcctgtgaaaatacagatactgattcagtgggtctgtgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctctctccacctgaaccatggcttttcatgcttccaagtgtcagggccttgcccagatagacagggctgactctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtttgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccatccagtctgttgaaggcctgagtgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgtaaa

SEQ ID NO: 314 - DNA, 4846 bp, Homo sapiens
atcttggattccgcggtagcggaggcggcggtcaggcgccgcttctggggagtggcctttcttttcccctccctcccggttcggtggcggcggctcctcccactgggggggggggtggcgcggcggcggtggcatctgcggccatggcggcgactactgccaaccccgaaatgacatcagatgtaccatcactgggtccagccattgcctctggaaactctggacctggaattcaaggtggaggagccattgtccagagggctattaagcggcgaccagggctggattttgatgatgatggagaagggaacagtaaatttttgaggtgtgatgatgatcagatgtctaacgataaggagcggtttgccaggtcggatgatgagcagagctctgcggataaagagagacttgccagggaaaatcacagtgaaattgaacggcggcgacggaacaagatgacagcctacatcacagaactgtcagatatggtacccacctgtagtgccctggctcgaaaaccagacaagctaaccatcttacgcatggcagtttctcacatgaagtccttgcggggaactggcaacacatccactgatggctcctataagccgtctttcctcactgatcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacagggcgtatcctggatctaaagactggaacagtgaaaaaggaaggtcagcagtcttccatgagaatgtgtatgggctcaaggagatcgtttatttgccgaatgaggtgtggcagtagctctgtggacccagtttctgtgaataggctgagctttgtgaggaacagatgcaggaatggacttggctctgtaaaggatggggaacctcacttcgtggtggtccactgcacaggctacatcaaggcctggcccccagcaggtgtttccctcccagatgatgacccagaggctggccagggaagcaagttttgcctagtggccattggcagattgcaggtaactagttctcccaactgtacagacatgagtaatgtttgtcaaccaacagagttcatctcccgacacaacattgagggtatcttcacttttgtggatcaccgctgtgtggctactgttggctaccagccacaggaactcttaggaaagaatattgtagaattctgtcatcctgaagaccagcagcttctaagagacagcttccaacaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagaactctagccaagaaccacggcctacactctccaacacaatccagaggccacaactaggtcccacagctaatttacccctggagatgggctcaggacagctggcacccaggcagcagcaacagcaaacagaattggacatggtaccaggaagagatggactggccagctacaatcattcccaggtggttcagcctgtgacaaccacaggaccagaacacagcaagccccttgagaagtcagatggtttatttgcccaggatagagatccaagattttcagaaatctatcacaacatcaatgcggatcagagtaaaggcatctcctccagcactgtccctgccacccaacagctattctcccagggcaacacattccctcctaccccccggccggcagagaatttcaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccagcaggtggctacccaggctactgctaagactcgtacttcccagtttggtgtgggcagctttcagactccatcctccttcagctccatgtccctccctggtgccccaactgcatcgcctggtgctgctgcctaccctagtctcaccaatcgtggatctaactttgctcctgagactggacagactgcaggacaattccagacacggacagcagagggtgtgggtgtctggccacagtggcagggccagcagcctcatcatcgttcaagttctagtgagcaacatgttcaacaaccgccagcacagcaacctggccagcctgaggtcttccaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaagaaacatgtgagtaagtgagagagagtgtgtgtgtatgtgtgtgtgtgtgtgtgtgcgcacacatgcttctgtatttcactctttctccctattagggagttatgcaaaatttgtccccgattttacctttgtctttctgtgtacttttcaaagagtcctaaggagttaaatcttccaggtattttccacttagtattgcagccaaagaatatttaaataaacgtctttgctgcgcttgcatccatgcccagccaatatacaactgtaaagcaaatatagaaagtcggctgttgatacgattgtctgttatcgaacacattcagtgataaagctgggttactgctgcttttggtgctctcaccttatctggaagatctgcaaacattacctaaataggctggcaagataaacactttctggaacccgagacttggccataaagataatgctgcatttttctgtcagaatcacatatgatgtgtgttctgtagaggttatttctgcatggaaactcaacttcttggattagccgtcccagtgaaaatcctcattgttggagtgtaaaccaaatacgaagccctcttgcaaagtagcctctttcatcccatactcaaaatacccagtttagcaagcaactgagatttaagtctctctggccctaagaggtttttcctctttgctccctccaatcttgagattgggttttgctttagagtgcaagtatcataattccgtatgatagatggggcctggacacccatctcaacagggtcacttggtaattaacaatagccatataaatgcggatacaggttactaccctcaccctttaccttcctcaggtaacagtcgtagataccagcttttttttttttttttttaaattggctttggccagtagctaaagtgcaagactgaattaatgagaagatatattaaatgtagtcataggggactgaggagcaagggtggccttgaagaggccaaaggaatgtccatttgctgagtttcccttccttatgtctccagtctggtgccaggtagtggagtaaaaaaggagacagtttatttttttattctatgtgcacacttacagtatacatatatatttatatcacaatttacgaaaccaaaaagttgagtttccaatggaacccttgttttttaataatcgactttttaaatgtgatcaggactataatattgtacagttattatagggcttttggggaaggggaggatagcgagaagatgctctgggggttttgtttttgcttttccttcagggttttatttttgactgttttgttttcttgttggccatttctgtattgctggcatctgtgctaagctttacagtggcaaaaataatgacatgtagcaaagattttcaaacaaaatattttttccttttgtaaaatttcttgtgttgtgtgatcttgattgcggctttatcattcctttccagttcataaacaacaggcacccacaaccagaggaatctatagtttaagctccagacatacaaacataaggcacattgtgtctttaatttcaggaatcagaaatcatagggttctgatcacattgcacgcctcccccctcacttgtcctcctgatcctgacacattctgagtaacatcagcaggaatgctctgaccatgaggtgggggttttggggtgggcgttgcctgggttcttgggagagaggggaagagtcgggacttgaaaaccactagggcacatctggatgccttcccccagtatgtccttttctggattaaaatgagtgaaatttaaactgaaaaaaaaaaaaaaaaaaaaaa

SEQ ID NO: 315 - DNA, 2360 bp, Homo sapiens
acgcgggggagctacaacagctgagacagaaaagaggtaaggaagtgttgggggctgggacaaccagctccccgacaactcctaggtgtttaaagaaggaggcaggaagacttgtgaagatgggaactatacaagaggcaggaaaaaagacagatgttgggtggagcaactgctacagaggtaaatatgattaactttacattccatctttcgtctgctcccaaacttaacagcaggtaatctgcttctagcaagtggtgaaggtaagagaagcatctgtataggaggcaagagatctgagtccttttgaaggcctatcctctgctctgtatctcaattactgttcttcatttcaattattcttacctactattcagttcccttgatcttttcttcttgggggctgtcttagggtcagggagattgcagaagcaccagaactaggagcagccctgagacatggggagttggagctgaaggaggaatggcaggatgaagaattccctagattgcttcctgaggaggctggcacttctgaagatcctgaagaccctaaaggagattcacaggcagctgcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatagcacaggactggataaagggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaaaaaaaaaaaaaaaaaa

SEQ ID NO: 316 - DNA, 2873 bp, Homo sapiens
ccttgctctcgccgctgctgccggagccgaagcagagaaggcagcgggtcccgtgaccgtcccgagagccccgcgctcccgaccagggggcgggggcggccccggggagggcggggcaggggcggggggaagaaagggggttttgtgctgcgccgggagggccggcgccctcttccgaatgtcctgcggccccagcctctcctcacgctcgcgcagtctccgccgcagtctcagctgcagctgcaggactgagccgtgcacccggaggagacccccggaggaggcgacaaacttcgcagtgccgcgacccaaccccagccctgggtagcctgcagcatggcccagctgttcctgcccctgctggcagccctggtcctggcccaggctcctgcagctttagcagatgttctggaaggagacagctcagaggaccgcgcttttcgcgtgcgcatcgcgggcgacgcgccactgcagggcgtgctcggcggcgccctcaccatcccttgccacgtccactacctgcggccaccgccgagccgccgggctgtgctgggctctccgcgggtcaagtggactttcctgtcccggggccgggaggcagaggtgctggtggcgcggggagtgcgcgtcaaggtgaacgaggcctaccggttccgcgtggcactgcctgcgtacccagcgtcgctcaccgacgtctccctggcgctgagcgagctgcgccccaacgactcaggtatctatcgctgtgaggtccagcacggcatcgatgacagcagcgacgctgtggaggtcaaggtcaaaggggtcgtctttctctaccgagagggctctgcccgctatgctttctccttttctggggcccaggaggcctgtgcccgcattggagcccacatcgccaccccggagcagctctatgccgcctaccttgggggctatgagcaatgtgatgctggctggctgtcggatcagaccgtgaggtatcccatccagaccccacgagaggcctgttacggagacatggatggcttccccggggtccggaactatggtgtggtggacccggatgacctctatgatgtgtactgttatgctgaagacctaaatggagaactgttcctgggtgaccctccagagaagctgacattggaggaagcacgggcgtactgccaggagcggggtgcagagattgccaccacgggccaactgtatgcagcctgggatggtggcctggaccactgcagcccagggtggctagctgatggcagtgtgcgctaccccatcgtcacacccagccagcgctgtggtgggggcttgcctggtgtcaagactctcttcctcttccccaaccagactggcttccccaataagcacagccgcttcaacgtctactgcttccgagactcggcccagccttctgccatccctgaggcctccaacccagcctccaacccagcctctgatggactagaggctatcgtcacagtgacagagaccctggaggaactgcagctgcctcaggaagccacagagagtgaatcccgtggggccatctactccatccccatcatggaggacggaggaggtggaagctccactccagaagacccagcagaggcccctaggacgctcctagaatttgaaacacaatccatggtaccgcccacggggttctcagaagaggaaggtaaggcattggaggaagaagagaaatatgaagatgaagaagagaaagaggaggaagaagaagaggaggaggtggaggatgaggctctgtgggcatggcccagcgagctcagcagcccgggccctgaggcctctctccccactgagccagcagcccaggaggagtcactctcccaggcgccagcaagggcagtcctgcagcctggtgcatcaccacttcctgatggagagtcagaagcttccaggcctccaagggtccatggaccacctactgagactctgcccactcccagggagaggaacctagcatccccatcaccttccactctggttgaggcaagagaggtgggggaggcaactggtggtcctgagctatctggggtccctcgaggagagagcgaggagacaggaagctccgagggtgccccttccctgcttccagccacacgggcccctgagggtaccagggagctggaggccccctctgaagataattctggaagaactgccccagcagggacctcagtgcaggcccagccagtgctgcccactgacagcgccagccgaggtggagtggccgtggtccccgcatcaggtaattctgcccaaggctcaactgccctctctatcctactccttttcttccccctgcagctctgggtcacctgacctgtagtcctttaacccaccatcatcccaaactctcctgtcctttgccttcattctcttacccacctctacctatgggtctccaatctcggatatccaccttgtgggtatctcagctctccgcgtctttaccctgtgatcccagccccgccactgaccatctgtgacccttccctgccattgggccctccacctgtggctcacatctcgccagccccacagagcatcctcaggcctctccaagggtcctcatcacctattgcagccttcagggctcggcctattttccactactcccttcatccgcctgtgtgccgtcccctttagctgcctcctattgatctcagggaagcctgggagtcccttctcacccctcaacctccggagtccaggagaacccgtacccccacagagccttaagcaactacttctgtgaagtattttttgactgtttcatggaaaacaagccttggaaataaatctctattaaaccgctttgtaaccaaaaaaaaaaaaaaaaa

SEQ ID NO: 317 - DNA, 1365 bp, Homo sapiens
atgctctcggtccgcgtccggatcacttccatcgctgacccacagcaacagcagctcttgctgctgaaggttctcagtctggccaacaaggagaacacgccctcgaccctgagcggaactcgcatcctggccagcaaggcggcgaggaggatcttccaggaaccagcggagccgaaaactaaaatagctgctcctggcgtggaggatgaaccactgctgagagaagaccccgccactttatcatcttccccaacgagtaccatgatatttggcagatcaagtgatggcatagtaaatgaaaacttggtggagcgatttagccaagaagttcagattacagaagcccgctgtttctatgacttccaaattgccatggaaaacacacattctgaaatgtatagtctccttattgacacttacataaaagatgccaaagaaagggaatttctcttcaacaccattgaaacaccttgtgtcaagaaggcaaattgggccttgagttgtattggggacaaagaggctacctatggtgaatgtgtttcccaggaggtcggccttctgcagttgccaagcaacgagtgtaaacagcacaagatcatggccactaactacagtgccaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggcaaatccttggggttccttcatgggcacctggcaaatgcctctgaagataccccctgctcgggtgaccctgacctcccgtacaactgctggtgctgcctccctcaccaaatggatacagaaaaatcctgatttactcaaggcctccaatgggctgtgtcctgaaatcttaggcaagccccatgatccagacagtcagaagaaactcagaaagaagtctatcacaaagactgtacaacaagcacgaagtccaaccataattccaagctccccagctgccaacctcaattccccagatgaactccaaagctcacacccctctgcaggtcatactccaggtccccaaagaccagccaaatcctaagagcccacctggaagtccacgtatgctagaactctgggcagggcctaatctagctgaggtccagaaatacaaacctggaacttcatatggaccaagtggccacacactgaaaaacccgtatagcgactcagtgaaataaacaagagcccccagtcagaactgtgaaacagggaaattttggggtgggagtaaaagcaaatttggaaaataaacttttttttgttgaatctttta

SEQ ID NO: 318 - DNA, 1747 bp, Homo sapiens
ccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctg

SEQ ID NO: 319 - DNA, 2275 bp, Homo sapiens
  modified_base (2005)..(2005): a, c, g, t, unknown or other
gctaacctagtgcctatagctaaggcaggtacctgcatccttgtttttgtttagtggatcctctatccttcagagactctggaacccctgtggtcttctcttcatctaatgaccctgaggggatggagttttcaagtccttccagagaggaatgtcccaagcctttgagtagggtaagcatcatggctggcagcctcacaggtttgcttctacttcaggcagtgtcgtgggcatcaggtgcccgcccctgcatccctaaaagcttcggctacagctcggtggtgtgtgtctgcaatgccacatactgtgactcctttgaccccccgacctttcctgcccttggtaccttcagccgctatgagagtacacgcagtgggcgacggatggagctgagtatggggcccatccaggctaatcacacgggcacaggcctgctactgaccctgcagccagaacagaagttccagaaagtgaagggatttggaggggccatgacagatgctgctgctctcaacatccttgccctgtcaccccctgcccaaaatttgctacttaaatcgtacttctctgaagaaggaatcggatataacatcatccgggtacccatggccagctgtgacttctccatccgcacctacacctatgcagacacccctgatgatttccagttgcacaacttcagcctcccagaggaagataccaagctcaagatacccctgattcaccgagccctgcagttggcccagcgtcccgtttcactccttgccagcccctggacatcacccacttggctcaagaccaatggagcggtgaatgggaaggggtcactcaagggacagcccggagacatctaccaccagacctgggccagatactttgtgaagttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacgaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcagcaagttcattcctgagggctcccagagagtggggctggttgccagtcagaagaacgacctggacgcagtggcactgatgcatcccgatggctctgctgttgtggtcgtgctaaaccgctcctctaaggatgtgcctcttaccatcaaggatcctgctgtgggcttcctggagacaatctcacctggctactccattcacacctacctgtggcatcgccagtgatggagcagatactcaaggaggcactgggctcagcctgggcattaaagggacagagtcagctcacacgctgtctgtgactaaagagggcacagcagggccagtgtgagcttacagcgacgtaagcccaggggcaatggtttgggtgactcactttcccctctaggtggtgcccagggctggaggcccctagaaaaagatcagtaagccccagtgtccccccagcccccatgcttatgtgaacatgcgctgtgtgctgcttgctttggaaactngcctgggtccaggcctagggtgagctcactgtccgtacaaacacaagatcagggctgagggtaaggaaaagaagagactaggaaagctgggcccaaaactggagactgtttgtctttcctagagatgcagaactgggcccgtggagcagcagtgtcagcatcagggcggaagccttaaagcagcagcgggtgtgcccaggcacccagatgattcctatggcaccagccaggaaaaatggcagctcttaaaggagaaaatgtttgagccca

SEQ ID NO: 320 - DNA, 2446 bp, Homo sapiens
ctgaggcgcggcggccccgtggagcagcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctgatgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagaccaaaaaaaagtagagaaaggagctgaactccactctcgatgctacttacagaggacatctgtaaagtcttcataaaagaccttgaatgatgcctaggatggcagagcccctgggtcctactccatcctccagcctttgtccttgtcctggcctcctgctctccagatctgtaaactgggctcaaggactgtacaagcagagtacaactacccgcctccccggtgccagggcgcctgttgggtttggtcctgtgtagatgattcccagagtctcattcatccagctcctcttcagacagaaggtccccatggtcagacagctggtctgcattgctggtactggttgcatcatcctcatcctcagagctggcttcacaggcagtgtggaagagctgcatgagttctcgaaaatggtgggaaacctaagaaaggaggagggctgtattcactgatccttagtaacatgttaacatttatgaagcactatatattgatttgcaaaatcttttgtttattccaaaaaaa

SEQ ID NO: 321 - DNA, 3889 bp, Homo sapiens; identical to SEQ ID NO: 33

SEQ ID NO: 322 - DNA, 564 bp, Homo sapiens
taagcgctgacgcatgcgcatagctaaccgcacccggttcagctcgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtaaaaaaaaaaaaaaaaaaaaaaaaaaaaaaa

SEQ ID NO: 323 - DNA, 602 bp, Homo sapiens; identical to SEQ ID NO: 188

SEQ ID NO: 324 - DNA, 1653 bp, Homo sapiens
agtcagcacgggggtgctggaagagatcgggaataatagcgcagaccaatgagcctagggagatgctttcatcgtctctccttccctcaagtgttctggaacctatcatttgaattagccgagtcaggcaggagggggcggggaatccttccgcccttcttaggaggggctgcattgcagggggagagtgaactgacagactcagtcactgaagagggaaaaggagtgagaagacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttagaggtataaaacaggaggaaatattatggaaaatgaaaatagggaaaataattgaatcattttagaagtagctaatttcttttctcaaaagagtgtcccttcttcacacctactcactttacaactttgctcctaactgtgggttgaaaactctagctaaagaaagttatcaaatcttaacatgcattcctactattatgatagtttttaaggtttcaattcaatcttctgaacggcataagtcctattttagccttacctcctgcatttgcaatacgtaatactgatcagtgggcacagttcttcagctacattgagaccctgaaatgaacaattatattctgactcgacatcttgtccccaatccttccaaaaatattgatggtgatttgtgctaccatttactcgtttatttaataaagacattcaatcccagaaaaaaaaaaaaaaaaaaaaaaaaaaaaaa

SEQ ID NO: 325 - DNA, 4176 bp, Homo sapiens; identical to SEQ ID NO: 77

SEQ ID NO: 326 - DNA, 1603 bp, Homo sapiens; identical to SEQ ID NO: 76

SEQ ID NO: 327 - DNA, 1590 bp, Homo sapiens; identical to SEQ ID NO: 198

SEQ ID NO: 328 - DNA, 2376 bp, Homo sapiens
gaggaggagtggggaccgggcggggggtggaggaagaggcctcgcgcagaggagggagcaattgaatttcaaacacaaacaactcgacgagcgcgcacccaccgcgccggagccttgccccgatccgcgcccgccccgtccgtgcggcgcgcgggcggagacgccgtggccgcgccggagctcgggccgggggccaccatcgaggcgggggccgcgcgagggccggagcggagcggcgccgccaccgccgcacgcgcaaacttgggctcgcgcttcccggcccggcgcggagcccggggcgcccggagccccgccatgtcgcgatccaaccggcagaaggagtacaaatgcggggacctggtgttcgccaagatgaagggctacccacactggccggcccggattgacgagatgcctgaggctgccgtgaaatcaacagccaacaaataccaagtcttttttttcgggacccacgagacggcattcctgggccccaaagacctcttcccttacgaggaatccaaggagaagtttggcaagcccaacaagaggaaagggttcagcgaggggctgtgggagatcgagaacaaccctactgtcaaggcttccggctatcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaagaggaggatgaagaggaagaggctaccaaggaagatgctgaggccccaggcatcagagatcatgagagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattact

SEQ ID NO: 329 - DNA, 2390 bp, Homo sapiens
aaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccggactattaagatatcacttcctggaggccagaaaattgatgctgtggcatggaacacaaccccctaccaactagcccggcagatcagttcaacactggcagatactgcagtggctgctcaagtgaatggagaaccttatgatctggagcggcccttggagacagattctgacctcagatttctgacattcgattccccagaggggaaagcagtgttctggcactccagcacccatgtcctgggggcagcagctgaacaattcctaggtgctgttctctgcagaggtccaagtacagaatatggcttttaccatgatttcttcctgggaaaggagaggacaatccggggctcagagctgcctgttttggagcggatttgccaggaacttacagctgctgctcgacccttccggaggctagaggcttcacgggatcagcttcgccagttgttcaaggataacccctttaagcttcacttgattgaggagaaagtgacaggtccaacagcaacagtatatgggtgtggcacattggttgacctttgccagggcccccaccttcggcatactggacagattggaggactgaagctgctatcgaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggaacaggagctcttcttcttccatgaactgagccctgggagctgcttcttcctgccacgagggacaagggtgtataatgcactagtggcgtttatcagggctgagtatgcccatcgtggtttctccgaggtgaaaactcccacactgttttctacgaagctctgggaacagtcagggcactgggagcattatcaggaagacatgtttgccgtgcagcccccaggctctgacaggcctcccagctcccagagtgacgattctaccaggcatatcacagatacactcgccctcaagcctatgaactgccctgcacactgcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcagctggaagcagagatccaaagctgtcttgatttcctccgttccgtctatgccgttcttggcttctccttccgcctggcactgtccacccggccatctggcttcctgggggacccttgcctttgggaccaggccgaacaggtccttaaacaggccctgaaggaatttggagaaccctgggacctcaactctggagatggtgccttctatggacctaagattgacgtgcacctccacgatgccctgggccggccacatcagtgtgggacaattcagcttgacttccaactgcccctgagatttgacctccagtataaggggcaggcgggtgccctggagcgtccagtcctcattcaccgagcagtgctcggttctgtggaaagactgttgggagtgctggcagaaagctgcggggggaaatggccactgtggctgtccccgttccaggtggtggtcatccctgtggggagtgagcaagaggaatacgccaaagaggcacagcagagcctgcgggctgcaggactggtcagtgacctggatgcagactctggactgaccctcagccggagaatccgccgggcccagcttgcccactacaattttcagtttgtggttggccagaaagagcaaagtaagagaacagtgaacattcggactcgagataatcgtcgccttggggagtgggacttgcctgaggctgtgcagcgactggtggagctacagaacacgagggtcccaaatgccgaagaaattttctgagcctttgtacatagatgaggcaaaaacctgcgagtgccatcagcctccctcacatgggagaccccaacccagctgacaatgtggagcccccagaacttcagaactgtgtggaggcacatgtctgctctcctgaaaagagacttggtttggggaccccacaaaaggagggaagctgtagctgtttggatgtgaggagaatgaaactacaaaaaaaaaaaaaaaaaaa

SEQ ID NO: 330 - DNA, 4538 bp, Homo sapiens
tggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccataggggcacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggagagattggaaaggtgtatgagcattgtgacatcgatgactgctggtgtctcggagagagaagccaatgatgccctcaatgcgtatgtgtgcaaaggcctcccccagcatgaagaaatctgcctgggcctgtttactctcatcctcactgaacctgcccaagcccagaagtgttaccgggacttagctctggtgagtcgtgatggcatgaatattgtcctgaataaaatcaaccagatacttatggagaagtacctgaagctgcaggatacctgccgtactcagttggtgtggttggtacgggaactggtgaagagtggggttctgggagccgatggtgtttgtatgacgtttatgaagcagattgcaggtggagatgttacagccaaaaatatctggttggcagaaagtgttctggatatcctgacagagcaaagggagtgggtcctgaagagcagcatcctcattgccatggctgtttacacgtacctccgcctcatcgtggaccaccatgggactgcccagctccaggccctgcgacagaaggaagtagacttctgcatctcactgcttcgggaacggttcatggaatgtctgatgattggtcgggatctcgtaagactacttcagaatgttgctaggataccagaatttgaactgctttggaaagatattatccataatcctcaggccttgagtcctcagttcacaggtatcctacagcttcttcagtcaagaacatcccgaaaattcctagcatgtcgtctaaccccggacatggagactaaactcctcttcatgacatcccgggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacgtcaaatgtcgctgcctccaatgccaagctggctttgttttatgactggctgttctttagtccagacaaggatagcattatgaacatagaaccagccatcctggtcatgcaccactccatgaagccccacccagccatcactgccacactcctggacttcatgtgccgcatcattcccaacttctatccaccattggagggccacgtgcggcagggtgtcttttcctccctcaaccacattgtggagaaacgggtcttggcacacctagctcccctgtttgacaaccctaagttggataaggagctgcgggcaatgctgagagagaagtttcctgagttctgcagctcaccctccccacctgtggaagtcaaaattgaggagccagtttccatggagatggacaaccatatgtcggataaggatgagagttgctatgacaatgcagaggcagccttcagtgacgatgaagaggatctcaacagcaaaggaaagaagagggagtttcgcttccaccctatcaaggagacagttgtggaggagccagttgatatcaccccttaccttgaccagttggatgagtccctgagggacaaagtactccagctacagaaggggagtgatacggaggcccagtgtgaggtcatgcaggaaattgtggaccaggtcctggaggaagactttgactcggagcagctgtctgtccttgcttcctgcctacaggagctcttcaaggcccactttcgaggggaggtcctgcctgaggagattactgaggagtccctggaggagtctgtaggaaagcctctgtacctaatatttaggaacctatgtcagatgcaggaagacaacagcagcttctctctacttctagaccttctctccgagctatatcagaagcagcccaagattggctaccacctgctctactacctgagggccagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagagtttccagatgaaaccttgaggagcggagagctgctgaacatgatcgtggctgttattgactctgcacagctccaggagctggtctgccacgtgatgatgggtaacctggttatgtttcgaaaagactcagttctcaacatactcattcagagcctagactgggagacctttgagcagtattgtgcctggcagctctttctggcccacaatattcccctggagaccataatccccatcctgcagcacctcaaatacaaggagcacccagaggccctgtcctgcctactgcttcaactccgaagagaaaagcccagcgaggagatggtgaagatggtgctgagccggccctgccatcctgacgaccagttcaccaccagcatcctgcggcactggtgcatgaaacatgacgagctgctggccgagcacatcaagtccctgctcatcaagaacaacagcctgcctcgcaagagacagagcctgaggagctctagcagcaagctggcccagctgactctggagcagatcctggagcacttggacaatctgcggctcaacctgaccaacaccaagcagaacttttttagccagacgccaattctccaggcgctgcagcatgtccaagcgagctgtgacgaagcccacaagatgaaattcagtgatctcttctccctggcggaggaatatgaggactcttccaccaagccacccaagagccggcgaaaagcagctctgtccagccctcgaagtcgaaagaatgccacacagccccccaatgccgaagaagagtcgggctccagcagtgcttcagaagaggaagacacgaaaccgaagcctaccaagcggaaacgaaaagggtcctctgcagtgggctctgacagtgactgaggccctgcattccccatcccacccccggctggactgccctctccttcttggtgattcaaaggttaatagaggctgaggagattgcaggggaaacacccttgctgcatccccaagctcccccggtggaaggaggagctttctcctctggctgagtttgagaagctgccatgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcaaaaaaaaaaaaaaaaaaaaaaaaaaaaaaaaaaaaaaaaaaaaaaaaaaaaaaaa

SEQ ID NO: 331 - DNA, 417 bp, Homo sapiens
cgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaaaaaaaaaaaaaaaaaaaaaaaaaaaaaaaaaa

SEQ ID NO: 332 - DNA, 2991 bp, Homo sapiens; identical to SEQ ID NO: 47

SEQ ID NO: 333 - DNA, 507 bp, Homo sapiens
ggtgcttctgagatgtgggcttgcacacgctgttgctatagtacgtgtgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 334 - DNA, 1891 bp, Homo sapiens
agcacctgggaaaaggcagaccgtgtgagggggcctgtggccccagcgtgctgtggcctcggggagtgggaagtggaggcaggagccttccttacacttcgccatgagtttcctgatcgactccagcatcatgattacctcccaaatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgcgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacagatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagacatgtctatggtagctgagccaaacacgtaggatttccgttttaaggttcacatggaaaaggttatagctttgccttgagattgactcattaaaatcagagactgt

SEQ ID NO: 335 - DNA, 2445 bp, Homo sapiens
aggagagtcaggccaatggggccgcagttctttcttttttttttctttattcttatttttggagacagggtctcgctctgttgcccaggctggagtgcggtggtgcgatcacggttccatgcagcccccgacctcccgggctcaggtgattctcccgcctcagcaccgcgagcagctaggaccacaggcgcgagccactgcgtccggccggcgggacttatttgtcaggcggggattgggttccgccagcctaaagggaggggtaagcgccagaatatgaatcgccgggaagctgggagaaagctccgggaaaccctgagcagccaggtcgcctgctccgcccgctcccgctcccgatctctgattgctcctaactgacgtcactcccggtctgtccccgcccactcggtgctgccattggcagtcggtcgtgggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcctagtaagctgtttcgcggggggcgtctttttggccacttgtctcctggacctgctgcctgactacctggctgccatagatgaggccctggcagccttgcacgtgacgctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggctgggtgcagctctggcagagtcggcaggacctctgcaccagctggcccagtctgtgctagagggcatggcagctggcacctttctctatatcacctttctggaaatcctgccccaggagctggccagttctgagcaaaggatcctcaaggtcattctgctcctagcaggctttgccctgctcactggcctgctcttcatccaaatctagggggcttcaagagaggggcaggggagattgatgatcaggtgcccctgttctcccttccctcccccagttgtggggaataggaaggaaaggggaagggaaatactgaggaccaaaaagttctctgggagctaaagatagagcctttggggctatctgactaatgagagggaagtgggcagacaagaggctggccccagtcccaaggaacaagagatggtcaagtcgctagagacatatcaggggacattaggattggggaagacacttgactgctagaatcagaggttggacactatacataaggacaggctcacatgggaggctggaggtgggtacccagctgctgtggaacgggtatggacaggtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagaaaaaaaaaaaaaaaaaaa

SEQ ID NO: 336 - DNA, 6776 bp, Homo sapiens
gggagagggaagggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgaaaaaaaaaaaaaaaaaaaaa

SEQ ID NO: 337 - DNA, 1899 bp, Homo sapiens
ggaccccggttgctagggtgtgtctccttggcctcctagagggtggggatccgtggtgcttcttcgggaacagcctcctgcaggaagaccctcgctggacctttacctcgctgcctagattccgaggaaaaggagataggagacgaaaagccagttggtttggaaagcggccgattatcctaaagggtagtgtgggagtccagcacttccatgcccctctttgggtactacggaagggagatttccagcatcgtgtggaacatatgaccagggagtacaccttgagcgcttgtgtgcagttatcttttggcggattatgaaaaacagcacttattattcattaaaatgcaaaagcccccactgcttcttcgaagacccttacctccaaaattcactaagctgtctttacatgagaaaaaaacccatacagctaaaactggtaaaattgagtcactacatgtagcattcactgaagatgaaaccacttccattaaaatggatagaactcgttttcctgatgttttaagaaatcaatcactaacacctatcaatatccaaaatatctttcttgatcactgtgtacaagaaagagtgactgcaatttcatcaccccagaaatctactaagcatgtccgtgagcagattccagatactgctactggttccatattttttccacattgtaattcagcttctactcgaatttttgggaaacaaacaaacaaaatggaaagttcaagaaagtttaaaactatgaaagatgtttatactgaaaaaaggctagaaaacattttaattctttcttccaagttttccaaacctaaaagtactcctggctcagttatcgctcaaaaacttgagaaaatgcaccctaagcatcaacctttaccagagagtccaggctatacttatcagcacatctcgagagacttaagtgcaacagtgccaagccctccacctatgactgtatctatgaaaccagaaggacagtggcctgaacattttaaatcaactgctacattgacactaagagttactgaatttccaggttttgtttccttgccaacaccagttttaccaagaaaacctcacaggcagtctgtgatagaaactcttgtaacagaaaatggaaatatagaaagtgtcccaaagcaaatcccaccaagaccacctgaaggtctcaccaaaactgaaaaaatagaatcagagatacacgttgtacgtggtgaaggttttaagactgttgcagcaacacgatatgaaacaataacagccatgaccaacctggccatagtaaactgtcaagtatatgggagaaatgcacttaatctgaagggcttttttatcctaaattgtccagacttaacacctttggctttccagttgatatatcttaatttatcatttaatgatcttcattactttcccacagaaatattatgtcttaaaaatttacaaatactgaaattgagaaataatcctatcaaagaaattccttctgaaattcaacaacttgagttccttagaattttcaccattgcttttaatttaattactgttcttccaattgggttattttccttgtcttatcttgaagaacttgatgtttcctataatgaacttacttttattccaaatgaaattcagaaactcagatcacttgaaaaactgactgttgatgggaatgaactgagttttttcccccatggaattttgaagcttaacctgacaaaaattcagtttgagaataatttcactcatccttgtttttggagagataattatttgaataatccacaacaacttactcaaattatttctttgttcattgtccaaaataaactacataaattttatgataagatcccagtagaagttcagaagttactaaaatggtga

SEQ ID NO: 338 - DNA, 3665 bp, Homo sapiens
ttttttccttttctccagcggcctcaggttcttgttacaactgagtccgggttggaggaggtgtggggccgctgccgccaggaaaaacagcactggaggcaatgtttctataaatcaaagaagagacagtgtgagaatgtcagccctcaactggaagccgtttgtgtacggggggctggcctccatcactgctgagtgcggtacatttccaattgatttaaccaagacacggctccagattcaaggccagacgaatgatgcaaaatttaaggaaattagataccgaggaatgttgcacgcattagtgaggataggcagagaagaagggctgaaagcactctactcggggattgcccccgcgatgttacgccaggcatcctatggcaccatcaagataggcacttaccagagcttgaagcgactattcattgaacgcccagaagatgaaactctaccgataaatgtgatatgtggaattctgtctggagtcatatcttcaaccattgctaatccaactgatgttttgaaaattcggatgcaagcgcaaagcaacaccattcaaggaggaatgataggcaacttcatgaacatttaccagcaagaggggacaagaggactgtggaagggtgtgtcccttactgcgcagagggctgctattgttgttggtgtggagctgccggtctatgacatcaccaagaagcatcttattctctcaggcctgatgggagacactgtgtatacccacttcctctcaagcttcacctgtggtctggcaggggccctggcctcaaaccctgttgatgttgtgaggacacgtatgatgaatcagagagtgcttcgagatggcagatgttctggctacacaggaaccctggattgcttgttacagacatggaagaatgaagggttttttgctctctataaaggcttttggccaaattggttgagacttggtccttggaatatcattttctttgtgacatacgagcagttgaagaaattggatttgtgacaagccaaggctgcatgagacatctttctgaaaatggtaacttctgaaacagcaaagcttcctgtgtttcactctgcttctcactgcttggctcatcacagattctgggatgtgagcaacagatgaagactgggttagttgagattgctgtgtgttggcattggatgctcttcatcaaacgtttaatggcataaactaacatccaaacactagtctttaccactgaagtgcccttcaacatcaaagataatatgtgaaatgcatgtttcttgctaaagaaaacttgcaagaaaatcaggagcgatgtattgttttattcagggagagtagctcctgatgcatctcagctcatgactgagaatcagactgctctagaaaagctcactggaaccatggaatggagcctccgagaaggtgttatggtttctgaatttctgggagattttgctccttgtcaactgaagaaatttcatgtatggagacctggactgttcaaccccaggtataaacggtgcaggaaatggatcctaggaatatcacactgctttatcatttcctattttggcaggatcttccacttataataagtgattttaagctttgaagacttgacatttgtgagaaattgttacaaagtaataatctctaaattcgtggtggtgttatgtgttggctttgaaggttgcaaggtctgtattggtggggggtgttttcaagcagcttaggttctgtcttaggtcatgttagtaattagctttatgatttttagcaaagcatatgtatttctcaatgagtaaaatggggataataacgtctattgatgtagagggtcaaatgaagaacaaatagtagctgctgctacttgactggaaaggtaaatgtgtttacatcatgctgtggaacagctctaaacagtctatgtagaagaggggcatgttctcatgggcttctcatggtaattgtgaatgaagccctttgttaaggtcttgttgaagaaagaacactgtataagttcaggctttagtacattttccttagcaaaatgttggtagtgaatcaaagagttgatttttccaggtttccagtttttactttagtttatgttgtgcctgtcttggactttctgtttagtttggatggaaaatacctgcttgaaattttaaaaatgatttctttagtgcatctatttagctagtttctgataggtggtatgtaatattttccctttttctttccttctgtagacacaataagtcattctccctcttctttttttctttttctattttcttattctttactctaacctgcttcagagaaagagccctcttccttcttgtcttcatcttagtcttttcaaaataaaagatgactgtgagaaccccaagaacttccacttctgggaggcagccacaggacagggaacatatttatttgggtctcttcagttccccctttgagaacaacattaaatacatgttagctggggctccagggcattctccttccacagtagtgcggccaaattcccagtctggccagtctctttgttgagactgaatagaaggactgcaggtttttttggaggatgagataatttttcctcgcaggcatttttcccttgccttccttatgcatgaatggtccctttgaatattatttccaaaagtgagagctaagacaaagtcatcaaaaagagaggataacagaaggtgggggcgggggcggggtgcagtggggtagggttacctgttaattgctgagactcagatgaaagtccagctctccctgggcaaccctagagggcagcagaggaccccagagctcattcaggccttgctgcttgttctaaactacaccttaggattttttcttctttccaaaacattccattgattttataaagactttctatagagaggctttcacttttgagttctttgagtttaaagattgcttttcttgaaatgctctttttttaatgtagaaaaattttactttttcaaatatgcatacaatttttaaaacagtagaagcaaattcattttaatgaccatgtaaagagcgaatgtcagacagtattattaccagtttattcaaattacatacatgttcctaccaaggtggaaagaaattcaaacctcatggtaaaacttaagcacgatttaagataaaagcatagtatttcttcagtgtagacttattaagtgccttattgaacaggatcttaacctgctttttctgtttttttgaaagagttaatgcaattgttgaagcttctaaccaagaaacaacttaaggaattgggagacttggtcccctcgttgtcagggttctggctataagtacctccccacctttgggttttcttaaatatgccaaaaggaattctagtttttataaccaatgggtttttttgtttgtgtgcttatggatttgtgtaatcattgatgcttaatgttgtggattcataatataaaaagtggctcctgtcctttatatttattcatgtgctagaaatagtatgcattatataaagagtatgaagttttcataagcctttatatttcaagctctttatttaaacattgttggaatatgtggcataagccttgtttcatttatttaataaactggagtaatatataataat

SEQ ID NO: 339 - DNA, 2354 bp, Homo sapiens
tcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctagtgttgaatttcatgaaagaggaaagaatcataaggaaaatgtggcaaaaaggatcagtgagattaaacagaaaagcctggataaggcaaaggaagaagaaaaggcatcaaaggagtttgctgcaatggaggcagctgccctgaaagcataccaagaggatttgaaaagacttggcttagagtcagaaattttggagccaagcataacaccagtaaccagcactatcccacctacctcgacatcaaatcaacagaaagaaaagaaagaaaagaagaaaagaaaaaaagatccttcaaagggcagatgggtagaaggcataacctctgagggttaccattactattatgatcttatctcaggagcatctcagtgggagaaacctgaaggatttcaaggagacttaaaaaagacagcagtgaagaccgtttgggtagaaggtttaagtgaagatggttttacctattactataatacagaaacaggagaatccagatgggagaaacctgatgatttcattccacacactagtgatctgccttctagtaaggtcaatgaaaattcacttggcaccctagatgaatccaaatcatcagattcgcatagtgattctgatggggaacaggaagcagaagaaggaggggtctctacagagacagaaaagccaaaaataaagtttaaggaaaaaaataaaaatagtgatggaggaagtgacccagaaacacagaaagaaaaaagtattcagaaacagaattcattaggttcaaatgaagaaaaatcgaaaactcttaagaaatcaaacccatatggagaatggcaagaaattaaacaagaggttgagtctcatgaggaggtagatttggaacttccaagcactgaaaatgagtatgtatcaacttcagaagctgatggtggcggagaacccaaagtggtatttaaagaaaaaacagtcacttctcttggagttatggcagatggagtggccccagtcttcaaaaagagaagaactgaaaatggaaaatctagaaatttaaggcaacgaggtgatgatcaatagttgcaggagagctttttgtacatgcttttaggacagaatggagacttatacacccaaagtttatctgtgtttgtttgtaagtattatgatgctaaaaatttagatttattctaaatgtatttgatgtgaattaaaataaatattttttcatgtgaaatttattttggttcctaaaatggaagcctaccacattgcattgtaatacagtgtattatgttcagtgtctaaaaactgctaattaagtcataatttaagatgctatgtatctgttatttaaaacatggagaaacagggcctttattccattcatattcataagagcatatttatcctgcattgaaaatgcattacttttgcacattgatattaactgttgtccaacaaataagtatcggagtacgtgagaatattcccagcccagtgatgatttggttctgaggctgatgtgagaaagctgatgtaaaaaatgtatgcatattggcttaccttactcaatttaaagtcaaaagccaacagccaggagcagctcaggtacttcagatgtgcttaatatggagtgaaaactggaccagaggtggaaagatgtatttgccccagttcacttcaaagcagcaaacgttgtttaagcattttagtttgaaccaggcattgtgttaggaatccagggataaagatgaatgaaatgtatttctgttcttcaggagttcacattctagcatatgccttttttcccccagtcatgcactctttttagcagtcttatatgtactagaaaagattttttaaagtttatttaaagctgtgtagatgaaggcttgatctaaaatagtataaggtctccagcttcagtaaaagtttttagtgtttacttaaattagtaatttctcactttctgtctggttaaaatgtcttaaaaagtagaattttcttctttaatccgtttagtagttacctcccttttacttttcaaattcacaaaattacatttctcataaattgtatagtatttaacttataatagttaatatttgtctttttaagatgactgtacatgtaagaaaaaagcttattaaaaacttgatcaaagaaaaaaaaaaaaaaaaaaaaaaa

SEQ ID NO: 340 - DNA, 5723 bp, Homo sapiens
gcagccgccacattcaacaggcagcagcgcagcgggcgcgccgctggggagagcaagcggcccgcggcgtccgtccgtccttccgtccgcggccctgtcagctggagcgcggcgcaggctctgccccggcccggcggctctggccggccgtccagtccgtgcggcggaccccgaggagcctcgatgtggatggccccgcgaagttaagttctgggctcgcgcttccactccgccgcgccttcctcccagtttccgtccgctcgccgcaccggcttcgttcccccaaatctcggaccgtcccttcgcgccccctccccgtccgcccccagtgctgcgttctccccctcttggctctcctgcggctgggggaggggcgggggtcaccatggccgaggcgcctcaggtggtggagatcgacccggacttcgagccgctgccccggccgcgctcgtgcacctggccgctgcccaggccggagtttagccagtccaactcggccacctccagcccggcgccgtcgggcagcgcggctgccaaccccgacgccgcggcgggcctgccctcggcctcggctgccgctgtcagcgccgacttcatgagcaacctgagcttgctggaggagagcgaggacttcccgcaggcgcccggctccgtggcggcggcggtggcggcggcggccgccgcggccgccaccggggggctgtgcggggacttccagggcccggaggcgggctgcctgcacccagcgccaccgcagcccccgccgcccgggccgctgtcgcagcacccgccggtgccccccgccgccgctgggccgctcgcggggcagccgcgcaagagcagctcgtcccgccgcaacgcgtggggcaacctgtcctacgccgacctcatcaccaaggccatcgagagctcggcggagaagcggctcacgctgtcgcagatctacgagtggatggtcaagagcgtgccctacttcaaggataagggtgacagcaacagctcggcgggctggaagaattcaattcgtcataatctgtccctacacagcaagttcattcgtgtgcagaatgaaggaactggaaaaagttcttggtggatgctcaatccagagggtggcaagagcgggaaatctcctaggagaagagctgcatccatggacaacaacagtaaatttgctaagagccgaagccgagctgccaagaagaaagcatctctccagtctggccaggagggtgctggggacagccctggatcacagttttccaaatggcctgcaagccctggctctcacagcaatgatgactttgataactggagtacatttcgccctcgaactagctcaaatgctagtactattagtgggagactctcacccattatgaccgaacaggatgatcttggagaaggggatgtgcattctatggtgtacccgccatctgccgcaaagatggcctctactttacccagtctgtctgagataagcaatcccgaaaacatggaaaatcttttggataatctcaaccttctctcatcaccaacatcattaactgtttcgacccagtcctcacctggcaccatgatgcagcagacgccgtgctactcgtttgcgccaccaaacaccagtttgaattcacccagcccaaactaccaaaaatatacatatggccaatccagcatgagccctttgccccagatgcctatacaaacacttcaggacaataagtcgagttatggaggtatgagtcagtataactgtgcgcctggactcttgaaggagttgctgacttctgactctcctccccataatgacattatgacaccagttgatcctggggtagcccagcccaacagccgggttctgggccagaacgtcatgatgggccctaattcggtcatgtcaacctatggcagccaggcatctcataacaaaatgatgaatcccagctcccatacccaccctggacatgctcagcagacatctgcagttaacgggcgtcccctgccccacacggtaagcaccatgccccacacctcgggtatgaaccgcctgacccaagtgaagacacctgtacaagtgcctctgccccaccccatgcagatgagtgccctggggggctactcctccgtgagcagctgcaatggctatggcagaatgggccttctccaccaggagaagctcccaagtgacttggatggcatgttcattgagcgcttagactgtgacatggaatccatcattcggaatgacctcatggatggagatacattggattttaactttgacaatgtgttgcccaaccaaagcttcccacacagtgtcaagacaacgacacatagctgggtgtcaggctgagggttagtgagcaggttacacttaaaagtacttcagattgtctgacagcaggaactgagagaagcagtccaaagatgtctttcaccaactcccttttagttttcttggttaaaaaaaaaaacaaaaaaaaaaaccctcctttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttccagataaatgatttttgatgttattgttgggacttaagaacatttttggaatagatattgaactgtaataatgttttcttaaaactagagtctactttgttacatagtcagcttgtaaattttgtggaaccacaggtatttggggcagcattcataattttcattttgtattctaactggattagtactaattttatacatgcttaactggtttgtacactttgggatgctacttagtgatgtttctgactaatcttaaatcattgtaattagtacttgcatattcaacgtttcaggccctggttgggcaggaaagtgatgtatagttatggacactttgcgtttcttatttaggataacttaatatgtttttatgtatgtattttaaagaaatttcatctgcttctactgaactatgcgtactgcatagcatcaagtcttctctagagacctctgtagtcctgggaggcctcataatgtttgtagatcagaaaagggagatctgcatctaaagcaatggtcctttgtcaaacgagggattttgatccacttcaccattttgagttgagctttagcaaaagtttcccctcataattctttgctcttgtttcagtccaggtggaggttggttttgtagttctgccttgaggaattatgtcaacactcatacttcatctcattctcccttctgccctgcagattagattacttagcacactgtggaagtttaagtggaaggagggaatttaaaaatgggacttgagtggtttgtagaatttgtgttcataagttcagatgggtagcaaatggaatagaacttacttaaaaattggggagatttatttgaaaaccagctgtaagttgtgcattgagattatgttaaaagccttggcttaagaatttgaaaatttctttagcctgtagcaacctaaactgtaattcctatcattatgttttattactttccaattacctgtaactgacagaccaaattaattggctttgtgtcctatttagtccatcagtattttcaagtcatgtggaaagcccaaagtcatcacaatgaagagaacaggtgcacagcactgttcctcttgtgttcttgagaaggatctaatttttctgtatatagcccacatcacacttgctttgtcttgtatgttaattgcatcttcattggcttggtatttcctaaatgtttaacaagaacacaagtgttcctgataagatttcctacagtaagccagctgtattgtaagcttcccaccgtgatgatcatttttttgaagattcattgaacagccaccactctatcatcctcattttggggcagtccaagacatagctggttttagaaacccaagttcctctaagcacagcctcccgggtatgtaactgaacttggtgccaaagtacttgtgtactaatttctattactacgtactgtcactttcctcccgtgccattactgcatcataatacaaggaacctcagagcccccatttgttcattaaagaggcaactacagccaaaatcactgttaaaatcttactacttcatggagtagctcttaggaaaatatatcttcctcctgagtctgggtaattatacctctcccaagcccccattgtgtgttgaaatcctgtcatgaatccttggtagctctctgagaacagtgaagtccagggaaaggcatctggtctgtctggaaagcaaacattatgtggcctctggtagtttttttcctgtaagaatactgactttctggagtaatgagtatatatcagttattgtacatgattgctttgtgaaatgtgcaaatgatatcacctatgcagccttgtttgatttattttctctggtttgtactgttattaaaagcatattgtattatagagctattcagatattttaaatataaagatgtattgtttccgtaatatagacgtatggaatatatttaggtaatagatgtattacttggaaagttctgctttgacaaactgacaaagtctaaatgagcacatgtatcccagtgagcagtaaatcaatggaacatcccaagaagaggataaggatgcttaaaatggaaatcattctccaacgatatacaaattggacttgttcaactgctggatatatgctaccaataaccccagccccaacttaaaattcttacattcaagctcctaagagttcttaatttataactaattttaaaagagaagtttcttttctggttttagtttgggaataatcattcattaaaaaaaatgtattgtggtttatgcgaacagaccaacctggcattacagttggcctctccttgaggtgggcacagcctggcagtgtggccaggggtggccatgtaagtcccatcaggacgtagtcatgcctcctgcatttcgctacccgagtttagtaacagtgcagattccacgttcttgttccgatactctgagaagtgcctgatgttgatgtacttacagacacaagaacaatctttgctataattgtataaagccataaatgtacataaattatgtttaaatggcttggtgtctttcttttctaattatgcagaataagctctttattaggaattttttgtgaagctattaaatacttgagttaa

SEQ ID NO: 341 - DNA, 5161 bp, Homo sapiens
acttgggcgcgactggctttattgtaggtccccatgagctggtgggggctgtaggggtaaccaggcagggcgtctggcgctgttggggctgcgtttttccggagtccccctatgcgaggccgtgcccctcttcgcccggctcctggtgctccccagccgccggcccgctcccggaagctgcagcagctggtaacaaagagcctgccgggccgcctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggctgttttgacagaatacaaattaaaagcaattgaatatgtgcatggatacttttctagtgaacaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacagctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactctgactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagtgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaatattctgtgttttactaagtgcttggataggctttctaattttgtatacgtgctagagttaattattgaacatttttatccaaatttagttgtaactctgtttatactactgattgctcattcgtttaaatgatattttaatgtaaaagtcataaccaacatatgaacagacagatttatgtctttaaacacagaatgtaagctatagtttaatctgataccagttgctggaagttgccatttgtttttcttaaatctatacccataaaacttcttttaagattaaaaaaaaaaaaaaaaaaaaa

SEQ ID NO: 342 - DNA, 3760 bp, Homo sapiens
cacccaagtctgagttgctaaaaaatggagctgtcactgggccttgctctgccaggacctgcagagccggggacctctctgtggcaagcccagcaagatgactgctctgaggcgccctagggctgagggaggggccgtgacaccagccccgccccccagccacctgggaaaaggaagcacaaaaaggagaagcagcaacggctgctctgcttccttcccatctcgctcttgggtcatgcctggccagcagaaagcagctccataggggaggagagccacgcaggatctcacagctgcagtctaatagtaacacagaggattcagcagtggccaccatgggttctgtgaattccagaggtcacaaggcggaagcccaggtggtgatgatgggcctggactcggcgggcaagaccacgctcctttacaagctgaagggccaccagctggtggagaccctgcccactgttggtttcaacgtggagcctctgaaagctcctgggcacgtgtcactgactctctgggacgttggggggcaggccccgctcagagccagctggaaggactatctggaaggcacagatatcctcgtgtacgtgctggacagcacagatgaagcccgcttacccgagtcggcggctgagctcacagaagtcctgaacgaccccaacatggctggcgtccccttcttggtgctggccaacaagcaggaggcacctgatgcacttccgctgcttaagatcagaaacaggctgagtctagagagattccaggaccactgctgggagctccggggctgcagtgccctcactggggaggggctgcccgaggccctgcagagcctgtggagcctcctgaaatctcgcagctgcatgtgtctgcaggcgagagcccatggggctgagcgcggagacagcaagagatcttgatccagacagagcagcatatctttgctcatacaaactagaagaaccagctgatccttgagaaatttacgcttagtctatcaaacaagaaatgctggcttggcccggtggctcatgcctgtaatcccagcactgtgggagaccacggtgggggaatcccttgagcccaggagttggagagcaacatcacaacaccccatttctactaataatcaaaaaattggccgggcatggtggcatgtgcctgtagtcccagctacttgggaggctgaggcaggagaatcgcttgagcccaagaggtagaggttgcagtgagccaagatcgcgccactgcactccagtctgggcaacagagtgagaccctgtctcaataataataataataataatgatgatactctaagaaaaaaatctcaacatacttcatttaatagctcgttaccaagtgtgaatgaagcaatatgtcataatagagtagccactggttgcataataatagagacctaaattctcaaatagggaaagaggttttaaaatcaaatttgaggccaggtgcagtggctcatgggcggaggagggcagattacttgaggctaggagttcaagaccagcctggccaacatggtgaaaccccatctctactgaaaatacaaaaattaggcatagtggtgcacgcctgcagtcccagctactcaggaggttgaggcagaagaatcgcttgaacccaggaagtggaggttgcagtgagccgagattgtgctgctgcactccagcctgggtgaaaaagacaggctgtgtctccaaaaagaaaaaaaaaagtcaaattcaaatatcatctggacatgtcacaatggatcgcggatccttatgagtgattttccccagtggcccctggggatgtgccactgtcactcagaagggcaagctaggcagggcccatccaacagcaggggtctgcaggttagacgttccctgccctgggacgctcacccctgggcaagaggctggaagttcacaccatccaaaatttatccttgttttttttctgatgctaattagcctctcccgattttatgacatcttgtgttgatctttttcaaaaactcattttcttttttttccttctcttttctccttcttgtagcacatatctttcgttaaagatcagatcaataaaatattttatttattcattaatttaacaaaaaaaacagagcatttagtttgtggcaaaaacactgagctttcgaatatgaatcatgtgctttaggtgggagttgtgaattctgaagatacagatgacagtgacgaatgccttctgtctcatgattgacagggaaaaggaaggttgaccatagcatcctagaaggctcatcaggtgatcattacctagcatccatgaagcacctgaaattatttgcaaaatgttacgctttggaccatttttccggggaaggagatccagaactttttaccagattttcaaagacatctgtgactcccaaaagttaacaatcactgatgtggttgttgtatccctcatccaaccccagaacactttctgtaatctgagttttttaatggcaagtggcctatatttagcacctgttctcatgttaaacagctctgaatgttagatattctttcttatcctggactggttctctctatctctggagtaatgcagtataaattggccatcagtaccctcctaaaatctgagatctgccaggcccctcttctaacaccaggttaggcatgcttggttatttccagtacttgtgagtcaacatgtttcaagacgctgtgttagacactagggatgcaaagatgaatgagataaggcctcaggcctcatggaaggtgagacagtaaagacattactcccataaaaatgtgaggagagagactcagttcagcaactgtttattctgtttattgagcacttacttggaccaagcactgtggtcttggtgttttacatagactgtctctaattctcacaactctgcaaaatatatatattcccattttataaaactacaaactgaggctcagagaaggtgtgacctcttgttgcttgaggcacagagttataaagtaacatatctggaatttgaaatgagatctgtttagggctaatgctgcatttttctacaacatcatgcctctagaaggtttaagctaggtaggctttcagccagcagacatgatggggagagccttctaataagagggaagagactgcttggaagcatgaagggaggtgtaagaaagataagtaagtcagtgtacttgcaacagaggcttgggatgaagggtgggtgaagttgacatcacgatagaaaacaaaactggaatgggagtttaggtccaatttgggcaaggttgtttgaatttcaataatcaggggtttgggtcaaggaagaaaaatcatgggacttgccatttaggaggataattttgtggtagtgtggaggtgaaataaagagaaaagggaaccttggagctgggaaggcaggaaaccggctagatgaccatcacacagcaaaggagggagtggaagagagatgagaaaattgagagctattattaagaaaaacagttgagagaggaagaatttgaagagggctcaagattttgagtccacatgacagaaggactggaatgccatgaactggagaaggtgagcgctgaagaaccaggatgggacggggctggaacagctgggttcagcttttgcagggtgggtacgtgtttggttatagctgctttcagattgttccattatctgtactcccaacaaccctgccggatatatttgttggctttcactc

SEQ ID NO: 343 - DNA, 2022 bp, Homo sapiens
attccccaacctgatagccctccgcgacgcattacgcaccgcggacagctggagaggccgaggcgctctcgctttgatttcggcgcctccgccctcgcggggagagattggctgcggccgcgggacggggtagtgagcgcgtcacttcctgccgctgccaggcgcgtcctcccgcgcgctatgacggccagcgcacagccgcgcgggcggcggccaggagtcggagtcggagtcgtggtgaccagctgcaagcatccgcgttgcgtcctcctggggaagaggaaaggctcggttggagctggcagtttccaactccctggaggtcatctggagttcggtgaaacctgggaagaatgtgctcaaagggaaacctgggaagaagcagctcttcacctgaaaaatgttcactttgcctcagttgtgaattctttcattgagaaggagaattaccattatgttactatattaatgaaaggagaagtggatgtgactcatgattcagaaccaaagaatgtagagcctgaaaaaaatgaaagttgggagtgggttccttgggaagaactacctcccctggaccagcttttctggggactgcgttgtttaaaagaacaaggctatgatccatttaaagaagatctgaaccatctggtgggatacaaaggaaatcatctctaggtggccgagaagatttgattttctttaaaaagacaagaataaggtctggttagggaatgaaaaatgtatacatttcggaacaactccattttatctaaaaaagttcttgtgattgccagtttatttgcagtctcttaatgtatcccccactctttcagccagtacttgagaaaatttttctgaaatatgtcattgaattgtattccagacacagaatacatgataaatactgatattatgggtaatctgctttccatatttacctatgatatttactgtgcagtttgtcattactagcttgcatggagtaggatgcagtcaaatttgccttagtgtttctgttcaaatagagacctgaattcaaatattgtagtttaggttcaaacagagtatggctgttgcaaaatttaccaaatttgttgattacctcttttattaaagaaatgttggggagagggtaatatattgtgacaatttttgcaacttacagggaataggacaggtcattagggtgtatttcccaggtttccaattgagaatctaaaccaagagaagtgagacaaaccatctaatatctgtatcatgctattaataggctgtgatgttgagtttctcacttactctttctgaggtccagggtccttatatgaagagattcatatatatgaagagattcgtctagagcagtggttgtcaaagtgtggtctgggggggcctcaagagcctttcaagggtattctaggtcaaagctgtttttataacactaagacattatttcactatttatagcttttccttttttttatttgagaaggagtcttgctctgttgcccacattggagtgcagtggcacgatctcagctcattgcagcctccgccacctgggttcaagcaattctcctacctcagcttcccgagtagctgggattataggcacccaccaccacacctggctaatttttgtatttttagtggagacggggtttcaccatgttggccaggctggtctggaactcctgagctcaagtgatctgcccatctcagcctcccaaagtgctgggattacaggtatgagccacaacgcccagccatcatttatctttttcactcattttttcatgagtatgcagaggagttttcaagaggctatctggtgtgatattgtaataggctgaatgcaaaagcagatacaagattccagctttcgtctgtcatcagacattgaagagatttggagaaatgtaaagcagcagtactcttctcactaatttttattgtggttagttagaaaaatggttatttttagtgggttttaatatgtgaaaaaaataaaattagctatttgcc

SEQ ID NO: 344 - DNA, 3204 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggagtcacattaactttgctctagaagacaactttacaaggatctaaaaggaacaggattaaagatgactgaatactgggttccagaaatttaaaacaatcagcttagcaaatcatatattcttctgtggagctgagaattgatgtccgctcttccccgtgatttggaactttccaatcccagagaaaagttgacaaagggactgcccaggactgagtccatatggaagaagaacttcctcttttctctggagacagtggcaagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtctatgtctggggttacaacggaaacgggcagcttggactcggcaacagtggcaaccagccaaccccttgcagagtggcagctttgcaaggcatccgtgtccagagggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtggaacctgatgaccacctcacagtggctgagtcactgaagagggaatttgacaacccggacactgcagacctgaagtttctagttgatggaaagtacatttatgcacataaagtccttctcaagattcgatgtgagcattttcgttcgtcattggaagataacgaggatgatattgtagaaatgagtgaattttcatatcctgtttaccgggccttcctggaatacctatacacagacagcatcagcctttctcctgaggaggcagtaggactgctagacttggctacattttatagagaaaatcgtttgaaaaagctctgccaacaaactatcaagcaaggcatctgcgaggagaatgccatcgctctgctctcggctgcggtgaagtatgatgcacaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacagaaaaaaaaaaaaaaaaaaaaaaaaaaaaaaa

SEQ ID NO: 345 - DNA, 1408 bp, Homo sapiens
cgggaacgccgctcttcgcctctcagcggcggcttgtcctttgttccggacgcccgctcctcagccctgcgtcctggggtcgctgctgcatcccgcacgcctccaccggctgcagacccatggccgagcgcggggaactcgacttgaccggcgccaaacagaacacaggagtgtggctagtcaaggttcctaaatatttgtcacagcaatgggctaaagcctctggaagaggtgaagttgggaaactgcggattgccaagactcaaggaaggactgaggtgtcatttactttgaatgaggatcttgcaaatattcatgatattggtggaaaaccagcttcagtcagtgctcctagagaacatccatttgtcttgcaaagtgttggaggacagacattaacagtatttactgagagctcatcagataagctgtcattggaaggaatagtggtacaaagagctgaatgccgaccagctgccagtgaaaactacatgcgattaaaaagattgcaaatagaagagtcttccaaaccagtgaggctatcacaacagctggacaaagttgtaacaaccaattacaaacctgttgctaatcatcaatacaatatcgaatatgaaaggaaaaagaaagaagacggaaagcgagctcgagctgataaacaacatgttttagacatgctattttcagcctttgagaaacatcaatactataatcttaaggacttggtggacatcacaaaacaacctgtggtgtacctgaaggaaatcttaaaagaaattggtgttcagaatgtaaaagggatccacaaaaacacatgggagctgaagccagagtacagacactatcaaggagaagaaaagagtgactaagaagactcctagccagcatgctagtgaaaggctagcagcgatgctatgcaaaaggcgctgatactggaaggcttgaacaccgtatgtttaataggggttaagtgacagtactttgatttctctcggtaaattttttaaacctgtaaggcttgtaaagtttcttaactgtttttttgaggagaaagaacagatttatttatagacttaacttgtattaaaccagattattcacagtaggaataggggttggaggattaagagggtttttcttaaatattagcttttaatgtgtacaattaggaaatttttttaagtgaggactctctacccttgccgtatctaaggagctgaggtaatacagatccaaggagaattgtatagcaagaaaaaaacagtcaactacagaaactcttaaaaggaataaaaacccaaagttccttattttgaaattgtcaaagaacaaacggtgtttttcttttaaacaggtgatcacgtttcttttcatactcaacgttaataaaaggagagagtttgtagtg

SEQ ID NO: 346 - DNA, 4163 bp, Homo sapiens
ccgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcatgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataacgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctccagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgatt

SEQ ID NO: 347 - DNA, 1074 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagggactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattct

SEQ ID NO: 348 - DNA, 5947 bp, Homo sapiens
gcttgcttgcccggctcgctcacgggtcgttgaggccggtgacatgtctgtgagctgcggaggctgcggcccccagatctttctctttgacactttgcaataaaaaagggcagtgagattgaataggtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcagaaggaactatgcagtgtaacagcagaggactgtttacagcaggatgagcatgccaatttaactgaggtcacatttctgggttttaatgaagagacagatgctgctcatatacaggatttagctgcagtttctttggaacttccagatattctgaattcactccacttctgcagtctaaatgaaaatgaaattatttgtatgaagaatataaataaaccattagatataagcagtgatcctctaaatcagagtcatccttctggaatgctttgtgtcatgagagtgtcacctacatcaccaagacttaggattgattttatctttagtctcctaagtaaatatgctactggtataaggtacaccttggacacattcttgcatcagaagcaccaacttgagaccactgatgaagatgatgatgatactaaccagtctgtgtcatccatagaggatgactttgtcactgcttttgagcacttagaagaggaagagacttcaaagccatacaatgatggaatgaacattactgtgctaaggagccagtgtgatgctgcttcccagacggttactggtcatcatttagaaacccatgatttaaagattctcattagctctggacagcagaagtcattggctaaaccctcaacttcctcagtgaatgtcctgggacataaagaactaccttctgtgaaaacttcagtcacaacatcaatttcagagccttggacccaaaggagtttctataggtcatctaatgcttcagataaagatagtgatttacagaaaacatttttttcgtcttctcctgcctactcatctgaatcagaatgttcaagtccaagtcctgttattttcttggatgaagagggatatcaaaaaagcttaaaagcaaaacttgagctgcctaaaattcctgtgatgaaagatgatatagaggattcagactcagaagtaagtgaattttttgatagttttgatcagtttgatgaactagaacaaactttagagacttgcctgtttaacaaagatcccgtcatagggaagtcatcgcagaggaaagggcacaaacatggaaagtcatgtatgaatcctcaaaaattcaagtttgatcgtccagctctcccagctaatgttagaaagccaactcctcgtaaaccagaatctccatatggtaacctgtgtgatgctccggattctcctcgcccagtgaaggcatcaagggaagatagtggtttatttagtcctattcgatcctctgcttttagtcctcttggaggctgtactccagctgaatgtttttgccaaacagatattggtggagataggattcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccttgatcaaaaaaataaatctaaaaataaatccttaatgattaaagatagcattcaaaaatttgcagcagatcttgtggaaaaaagttttggcagtgcatttaaagacttacagaaaggagtctcttcatgtaccaatgctttgtaccacttagccatcaaattgacatcatctgttttgcagatggcatttgatgagctgagaaggcagcgtgcattttcactaaaagaacgtgccattagtggcctggctaactttttggtgagtgaagctttatcaaatgccttaaaagatttacagtatgtaaagaagcagatattcacaaacacagttgctaggtttgctgcagatcttgctgaagagcttgtttttgaaggcatcatggaggtgtgtcagttttcatatcctcaaacgcctgcatctccacagtgtgggtcgtttgactttgaagacaaagtagtgaagttgtatgcaaaagatttgtctgaatctgtaatacaggaagcattcattgagctatcacaagttgatgtgacctttacaacaaaggcagcagttagtgtctctacggataatatcaagtatgtgagtgcagaaagtgtagtgccatcgacacaggctgtcacgttttccccttcttttcacaatcaagcaattatggtgacaaaaccagtgcaggaatataaaaaggaatacacagtgcagcaggccttgttttgtacttctggaattgttacttctataccggtgcccttggcaggaagtgcccttctcccatatcatatttcatctactgcatgtcaggccaaggctcatctgtcatctgatgatagtaattcaaatggtgattctgcccaagtgcatattgccacaaaaaacagagaagaaaaagcagcttgtctcagaaatatttgtttaccttcagaacacaatccaggtaatcagaatgattttaaaccaactaatgacgatattgaaatgcagagttcctcaaaattaccaaatgatcctgcaattattagcaacttttctgcagcagtggtgcatacgatagtaaatgaaactttagagtcaatgacatcattggaagttacaaaaatggttgatgaacgtacagattatttaactaaatctttaaaggagaaaacccctccattttcccactgtgatcaggcagtgctgcaatgcagtgaagctagtagcaataaggacatgtttgctgaccggttatctaaatctattattaaacattccatagataagagcaaatcagtgatcccaaatatagataaaaatgcagtatacaaggaaagcttgcctgtttctggagaagaatcacagttgacaccagaaaagtctcccaaatttcctgactctcagaatcagttaactcactgctcactttcagctgcaaaggattgtgttccagaatgtaaagtttctatggttcatggatcctccctagagacactgccatcttgtccagctgtgacaggtcagaaatctgacttgaaggaatctgctaaggatcaaccactgaaaaagcataacttgaatagtacatcacttgaggccttgtcttttggacaggaaaacccctttcctcattcacatactttctcatctacagcacttacctgtgtagatggtttgcatgtggaagataaacagaaagtcagagacagaaatgtaatacctgatactcctccatcaactcctctagtaccatcccgggctagttctgaatgggatatcaagaagttaactaaaaagctcaagggagaattagccaaagagtttgcacctgctacaccaccttctactccacacaactcatctgttggtagtttgtctgagaatgaacaaaatactatagaaaaagaagagttcatgttgaaactcatgcgatctctttctgaagaagttgagagtagtgaaagtggagagctcccagaagtggatgtgaagtcggagcactcagggaagaaggttcagtttgcagaagcattagctacacacatcctttctcttgcaactgaaatggcagcttcccatttagataacaaaataattcaagaacccaaggttaaaaacccttgcttaaatgtgcaaagtcaaagaagtgtgtcgcctacttttttaaacccctcagacgaaaatttgaaaacattatgcaattttgcgggtgatctggcagcagaagtcattacagaagctgagaaaatagcaaaagtccgaaattgtatgcttttcaagcaaaagaagaacagttgttatgctgatggtgacgaagattataaagtagaagagaagttggatatagaggctgtagtgcacccaagagaagtggatccgtttattctttcattaccaccaagttcttgtatgtcaggtctgatgtataagtatcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagacaaaaagagacaaagtaaaagaaatgaaggttacttttgtaaaaatcaaacttgtgaaaggacctgtggaccatcagttgaacttagcccctggaaatggcaaactaggtgtgggagggaaggcaactcttggaaaagggaatgaggtagcataaggaaaggaaatggcttttcacctgatagaacacttcatctcgaagagttttgttcgatgcttggattaacctggaaatattaatatttttgtaaagtatattttgtcatagtttattatggtgctatataaaccaccaatatttcttaaaatctaggtccaaaaagacagtgtttaaaactggtagaagcaagtgggggcaatgtcacaaatcatgatttggcccttttctataactttatctagaaaaggatactaacatttagtttcttctctcattttgagaaacacaggcttctatgatttcagtggggttgacagtgttgcctaggaaatcctggcgttaaaatgggagattgaggtgtgggtagaggctttaagcattaagaggacttgtagtcagttgaacaactctgtgctgaatattatctaatttgatgagaaaaaggagtcgtcttaccggtttctgtccttggttctgtcctccttagcattatttattaatgatgtggaatactcatttgtggatgattcaacacaggctgaaaaaagaatctcattaacagaacaaaggttaaaaagaccaaatcaagctgaggttaaaataattatgtttaacatggataaatgcatttaggctcagaaaattaatgattaatatttgaacttaagtggggagcaaacctggcttgatggcattttgtcagaaaaagacctgtgtttccattgaccaaagttgtaatgtgacttaatgtaatgctgcgtggcattaaggttctggcacagagaaaaagcggggctcatccaggattggtggtgtgctcgttgcatatacagtgtccagggtctcacctccagagatgaagatttatgaagtcagtgaagggtcctgagaatctgcatgcttgataagcatcacagatgatttcagtgcaggtgattcagagacctcacttgaaaatatattgatttacaagatatgttgcatctgttgatgacaattgatatctatactgttcttttctgctacagagatcaaggtaggagataaagacttcggcgatttgggctgggcgcggtgattcacgcctgtaatcccagaactctgggaagccaatgggggtgggggtggatcacttgaggtcaggagttcaagaccagcctgggcaacatggtgaaaccccgtctctaccaaaaatacaaaaattagccaggcgtggtggcaggcacctgtaatcccagctacttgggaggctaaggcaggagaattgcttgaacctgggaggcagagattgcagtgagctgagattgtgccactgtactccatcctgggcgacagagacagactccgtc

SEQ ID NO: 349 - DNA, 1431 bp, Homo sapiens
ccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataagtaagtatatttcagtgaggtatattttaatactgatcaatgtgaacttttctaaatactctattgtctttaataattgtgctgaaatctatttccttttataatagattaaaaattttatatttttataagtaaacagtgatttttgaaaagtcagccttgtgggatgaaaaatatgtcttactggaaaaatccctcataataacctaatagggcattgctattaaaaatgctaaaataaaaattcagcttatgagaaatggcaaaaaaaaaaaaaaaaaaaaaaaaaaaaaaaaaaaaaaaaa

SEQ ID NO: 350 - DNA, 2097 bp, Homo sapiens
tccctctgctatggctcttcctcagtagaaacaactggcaacaaaattcaagtttatgattcattcatcagcaaacatgtgagaatcatctacaaagaaccaagaattgtgagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttaatatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctaattttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagttaaaaaaaaaaa

SEQ ID NO: 351 - DNA, 1508 bp, Homo sapiens
cgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaaactctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtaaaaaaaaaaaa

SEQ ID NO: 352 - DNA, 1284 bp, Homo sapiens
ggttcatttcgtgtctcggcgatgtttcctagagtctcgacgttcctacctcttcgccccctttcccgccaccctttgtcctctggaagcccggagacatcagcggctgcgattatgctactcactgttcggcacggaacagtcaggtaccgcagttcagcgctgttggcccggacaaaaaataacatccaaagatattttggcactaacagtgtgatctgtagcaagaaagataagcagtctgttcgaactgaggagacttccaaggagacttcagagagccaagacagtgaaaaggaaaatacgaaaaaagacttgttaggcattattaagggcatgaaagttgaattaagcacagtaaatgtacgaacaacaaagccccccaaaagaagaccacttaaaagtttggaagctacacttggcaggcttcgaagagctacagaatatgctccaaagaagagaattgagcccctgagtcctgagttggtggcagctgcatctgctgtggcagattctctcccttttgataagcaaacaaccaagtcagagctgctgagccagctccagcagcatgaggaagagtcaagggcacagagagatgcaaagcgacctaaaattagtttcagtaacataatatcagatatgaaagttgccagatctgctacagctagagttcgttcaagaccagagcttcggattcagtttgatgaaggctatgacaattatcctggccaggagaagacggatgatcttaaaaaaaggaaaaatatattcacagggaaaagacttaatatttttgacatgatggcagttactaaagaagcacctgaaacagacacatcaccttcactttggaatgtggaatttgctaagcagttagccacagtaaatgaacaaccccttcagaatggatttgaagagctgatccagtggacaaaagaggggaaactatgggagttcccaattaacaatgaagcaggttttgatgatgatggttcagaatttcatgaacatatatttctggagaaacacctggagagctttccaaaacaaggaccaattcgccacttcatggagctggtgacttgtggcctttccaaaaacccatatcttagtgttaaacagaaggttgaacacatagagtggtttagaaattattttaatgaaaaaaaggatattctaaaagaaagtaacatacagttcaattaagaccatggaaatttttatttcaaacaattagagatggatattacaactaaataaaataattttactagagtttgt

SEQ ID NO: 353 - protein, 194 aa, Homo sapiens [sequence omitted]

SEQ ID NO: 354 - protein, 404 aa, Homo sapiens
MFVQEEKIFAGKVLRLHICASDGAEWLEEATEDTSVEKLKERCLKHCAHGSLEDPKSITHHKLIHAASERVLSDARTILEENIQDQDVLLLIKKRAPSPLPKMADVSAEEKKKQDQKAPDKEAILRATANLPSYNMDRAAVQTNMRDFQTELRKILVSLIEVAQKLLALNPDAVELFKKANAMLDEDEDERVDEAALRQLTEMGFPENRATKALQLNHMSVPQAMEWLIEHAEDPTIDTPLPGQAPPEAEGATAAASEAAAGASATDEARDELTEIFKKIRRKREFRADARAVISLMEMGFDEKEVIDALRVNNNQQNAACEWLLGDRKPSPEELDKGIDPDSPLFQAILDNPVVQLGLTNPKTLLAFEDMLENPLNSTQWMNDPETGPVMLQISRIFQTLNRT

SEQ ID NO: 355 - protein, 1195 aa, Homo sapiens
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTGEACDADFDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 356 - protein, 203 aa, Homo sapiens [sequence omitted]

SEQ ID NO: 357 - protein, 103 aa, Homo sapiens
MAQFVRNLVEKTPALVNAAVTYSKPRLATFWYYAKVELVPPTPAEIPRAIQSLKKIANSAQTGSFKQLTVKEAVLNGLVATEVLMWFYVGEIIGKRGIIGYDV

SEQ ID NO: 358 - protein, 377 aa, Homo sapiens
MVLESTMVCVDNSEYMRNGDFLPTRLQAQQDAVNIVCHSKTRSNPENNVGLITLANDCEVLTTLTPDTGRILSKLHTVQPKGKITFCTGIRVAHLALKHRQGKNHKMRIIAFVGSPVEDNEKDLVKLAKRLKKEKVNVDIINFGEEEVNTEKLTAFVNTLNGKDGTGSHLVTVPPGPSLADALISSPILAGEGGAMLGLGASDFEFGVDPSADPELALALRVSMEEQRQRQEEEARRAAAASAAEAGIATTGTEDSDDALLKMTISQQEFGRTGLPDLSSMTEEEQIAYAMQMSLQGAEFGQAESADIDASSAMDTSEPAKEEDDYDVMQDPEFLQSVLENLPGVDPNNEAIRNAMGSLASQATKDGKKDKKEEDKK

SEQ ID NO: 359 - protein, 292 aa, Homo sapiens
MSHLSQQKIYSGENPFACKVCGKVFSHKSNLTEHEHFHTREKPFECNECGKAFSQKQYVIKHQNTHTGEKLFECNECGKSFSQKENLLTHQKIHTGEKPFECKDCGKAFIQKSNLIRHQRTHTGEKPFVCKECGKTFSGKSNLTEHEKIHIGEKPFKCSECGTAFGQKKYLIKHQNIHTGEKPYECNECGKAFSQRTSLIVHVRIHSGDKPYECNVCGKAFSQSSSLTVHVRSHTGEKPYGCNECGKAFSQFSTLALHLRIHTGKKPYQCSECGKAFSQKSHHIRHQKIHTH

SEQ ID NO: 360 - protein, 639 aa, Homo sapiens
MVDYIVEYDYDAVHDDELTIRVGEIIRNVKKLQEEGWLEGELNGRRGMFPDNFVKEIKRETEFKDDSLPIKRERHGNVASLVQRISTYGLPAGGIQPHPQTKNIKKKTKKRQCKVLFEYIPQNEDELELKVGDIIDINEEVEEGWWSGTLNNKLGLFPSNFVKELEVTDDGETHEAQDDSETVLAGPTSPIPSLGNVSETASGSVTQPKKIRGIGFGDIFKEGSVKLRTRTSSSETEEKKPEKPLILQSLGPKTQSVEITKTDTEGKIKAKEYCRTLFAYEGTNEDELTFKEGEIIHLISKETGEAGWWRGELNGKEGVFPDNFAVQINELDKDFPKPKKPPPPAKAPAPKPELIAAEKKYFSLKPEEKDEKSTLEQKPSKPAAPQVPPKKPTPPTKASNLLRSSGTVYPKRPEKPVPPPPPIAKINGEVSSISSKFETEPVSKLKLDSEQLPLRPKSVDFDSLTVRTSKETDVVNFDDIASSENLLHLTANRPKMPGRRLPGRFNGGHSPTHSPEKILKLPKEEDSANLKPSELKKDTCYSPKPSVYLSTPSSASKANTTAFLTPLEIKAKVETDDVKKNSLDELRAQIIELLCIVEALKKDHGKELEKLRKDLEEEKTMRSNLEMEIEKLKKAVLSS

SEQ ID NO: 361 - protein, 847 aa, Homo sapiens
MSLFKARDWWSTILGDKEEFDQGCLCLANVDNSGNGQDKIIVGSFMGYLRIFSPHPAKTGDGAQAEDLLLEVDLRDPVLQVEVGKFVSGTEMLHLAVLHSRKLCVYSVSGTLGNVEHGNQCQMKLMYEHNLQRTACNMTYGSFGGVKGRDLICIQSMDGMLMVFEQESYAFGRFLPGFLLPGPLAYSSRTDSFLTVSSCQQVESYKYQVLAFATDADKRQETEQQKLGSGKRLVVDWTLNIGEQALDICIVSFNQSASSVFVLGERNFFCLKDNGQIRFMKKLDWSPSCFLPYCSVSEGTINTLIGNHNNMLHIYQDVTLKWATQLPHIPVAVRVGCLHDLKGVIVTLSDDGHLQCSYLGTDPSLFQAPNVQSRELNYDELDVEMKELQKIIKDVNKSQGVWPMTEREDDLNVSVVVSPNFDSVSQATDVEVGTDLVPSVTVKVTLQNRVILQKAKLSVYVQPPLELTCDQFTFEFMSIPRVIQCKFRLPLKLICLPGQPSKTASHKITIDTNKSPVSLLSLFPGFASQSDDDQVNVMGFHFLGGARITVLASKTSQRYRIQSEQFEDLWLITNELILRLQEYFEKQGVKDFACSFSGSIPLQEYFELIDHHFELRINGEKLEELLSERAVQFRAIQRRLLARFKDKTPAPLQHLDTLLDGTYKQVIALADAVEENQGNLFQSFTRLKSATHLVILLIALWQKLSADQVAILEAAFLPLQEDTQELGWEETVDAAISHLLKTCLSKSSKEQALNLNSQLNIPKDTSQLKKHITLLCDRLSKGGRLCLSTDAAAPQTMVMPGGCTTIPESDLEERSVEQDSTELFTNHRHLTAETPRPEVSPLQGVSE

SEQ ID NO: 362 - protein, 230 aa, Homo sapiens
MAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 363 - protein, 414 aa, Homo sapiens
MHHVLLEVDVLEGTLQCPESGRVFPISRRIPNMLLNDEETELIMPVFPEFLNQTRRPQWQETIADEKQQGATLVSCKGLSLRDPDLHLQNEHREMFQEEKYFRDSKGRPAQDGGPLGTQLLGRRLGTPIGSQRVPGGDGDVPILTTEDDMVSQPAKILNFLRKQKYNADYELSAKQGADTLAYIALLEEKLLPAVLHTFWVESDNYFTVTKPWFASQIPFPLSLILPGRMSKGALNRILLTRGQPPLYHLREVEAQIYRDAKECLNLLSNRLGTSQFFFGDTPSTLDAYVFGFLAPLYKVRFPKVQLQEHLKQLSNLCRFCDDILSSYFRLSLGAFSCMNRNQQQIDFGISPAGQETVDANLQKLTQLVNKESNLIEKMDDNLRQSPQLPPRKLPTLKLTPAEEENNSFQRLSP

SEQ ID NO: 364 - protein, 299 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 365 - protein, 1087 aa, Homo sapiens
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAHQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGVSVTSSNTGVPDISGSVYSKTQQSFEKQGFHSGTPAASFNLPSALGSGGPINPATAAAYPPAPFMHILTPHQQPHSQILHHHLQQDGQTGSGQRSQTSSIPQKPQTNKSAYNSYSWGAN

SEQ ID NO: 366 - protein, 423 aa, Homo sapiens
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 367 - protein, 118 aa, Homo sapiens
MRGRKMASATRLIQRLRNWASGHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 368 - protein, 749 aa, Homo sapiens
MARKLSVILILTFALSVTNPLHELKAAAFPQTTEKISPNWESGINVDLAISTRQYHLQQLFYRYGENNSLSVEGFRKLLQNIGIDKIKRIHIHHDHDHHSDHEHHSDHERHSDHEHHSDHEHHSDHNHAASGKNKRKALCPDHDSDSSGKDPRNSQGKGAHRPEHASGRRNVKDSVSASEVTSTVYNTVSEGTHFLETIETPRPGKLFPKDVSSSTPPSVTSKSRVSRLAGRKTNESVSEPRKGFMYSRNTNENPQECFNASKLLTSHGMGIQVPLNATEFNYLCPAIINQIDARSCLIHTSEKKAEIPPKTYSLQIAWVGGFIAISIISFLSLLGVILVPLMNRVFFKFLLSFLVALAVGTLSGDAFLHLLPHSHASHHHSHSHEEPAMEMKRGPLFSHLSSQNIEESAYFDSTWKGLTALGGLYFMFLVEHVLTLIKQFKDKKKKNQKKPENDDDVEIKKQLSKYESQLSTNEEKVDTDDRTEGYLRADSQEPSHFDSQQPAVLEEEEVMIAHAHPQEVYNEYVPRGCKNKCHSHFHDTLGQSDDLIHHHHDYHHILHHHHHQNHHPHSHSQRYSREELKDAGVATLAWMVIMGDGLHNFSDGLAIGAAFTEGLSSGLSTSVAVFCHELPHELGDFAVLLKAGMTVKQAVLYNALSAMLAYLGMATGIFIGHYAENVSMWIFALTAGLFMYVALVDMVPEMLHNDASDHGCSRWGYFFLQNAGMLLGFGIMLLISIFEHKIVFRINF

SEQ ID NO: 369 - protein, 123 aa, Homo sapiens
MHPFPESKPVLALCVISYFVMMGILTIYTSYKEKSIFLVAHRKDPTGMDPDDIWQLSSSLKRFDDKYTLKLTFISGRTKQQREAEFTKSIAKFFDHSGTLVMDAYEPEISRLHDSLAIERKIK

SEQ ID NO: 370 - protein, 1073 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAREYMNKIYFEDVTEFLEEVIEALILDEEVRTFPEVMIPVFDILLGRIKDLELCQILLYAYLDILLYFTRQKDMAKVFVEYIQPKDPTNGQMYQKTLLGVILSISCLLKTPGVVENHGYFLNPSRSSPQEIKVQEANIHQFMAQFHEKIYQMLKNLLQLSPETKHCILSWLGNCLHANAGRTKIWANQMPEIFFQMYASDAFFLNLGAALLKLCQPFCKPRSSRLLTFNPTYCALKELNDEERKIKNVHMRGLDKETCLIPAVQEPKFPQNYNLVTENLALTEYTLYLGFHRLHDQMVKINQNLHRLQVAWRDAQQSSSPAADNLREQFERLMTIYLSTKTAMTEPQMLQNCLNLQVSMAVLLVQLAIGNEGSQPIELTFPLPDGYSSLAYVPEFFADNLGDFLIFLRRFADDILETSADSLEHVLHFITIFTGSIERMKNPHLRAKLAEVLEAVMPHLDQTPNPLVSSVFHRKRVFCNFQYAPQLAEALIKVFVDIEFTGDPHQFEQKFNYRRPMYPILRYMWGTDTYRESIKDLADYASKNLEAMNPPLFLRFLNLLMNDAIFLLDEAIQYLSKIKIQQIEKDRGEWDSLTPEARREKEAGLQMFGQLARFHNIMSNETIGTLAFLTSEIKSLFVHPFLAERIISMLNYFLQHLVGPKMGALKVKDFSEFDFKPQQLVSDICTIYLNLGDEENFCATVPKDGRSYSPTLFAQTVRVLKKINKPGNMIMAFSNLAERIKSLADLQQQEEETYADACDEFLDPIMSTLMCDPVVLPSSRVTVDRSTIARHLLSDQTDPFNRSPLTMDQIRPNTELKEKIQRWLAERKQQKEQLE

SEQ ID NO: 371 - protein, 1972 aa, Homo sapiens
MGDDSEWLKLPVDQKCEHKLWKARLSGYEEALKIFQKIKDEKSPEWSKFLGLIKKFVTDSNAVVQLKGLEAALVYVENAHVAGKTTGEVVSGVVSKVFNQPKAKAKELGIEICLMYIEIEKGEAVQEELLKGLDNKNPKIIVACIETLRKALSEFGSKIILLKPIIKVLPKLFESREKAVRDEAKLIAVEIYRWIRDALRPPLQNINSVQLKELEEEWVKLPTSAPRPTRFLRSQQELEAKLEQQQSAGGDAEGGGDDGDEVPQIDAYELLEAVEILSKLPKDFYDKIEAKKWQERKEALESVEVLIKNPKLEAGDYADLVKALKKVVGKDTNVMLVALAAKCLTGLAVGLRKKFGQYAGHVVPTILEKFKEKKPQVVQALQEAIDAIFLTTTLQNISEDVLAVMDNKNPTIKQQTSLFIARSFRHCTASTLPKSLLKPFCAALLKHINDSAPEVRDAAFEALGTALKVVGEKAVKPFLADVDKLKLDKIKECSEKVELIHGKKAGLAADKKEFKPLPGRTAASGAAGDKDTKDISAPKPGPLKKAPAAKAGGPPKKGKPAAPGGAGNTGTKNKKGLETKEIVEPELSIEVCEEKASAVLPPTCIQLLDSSNWKERLACMEEFQKAVELMDRTEMPCQALVRMLAKKPGWKETNFQVMQMKLHIVALIAQKGNFSKTSAQVVLDGLVDKIGDVKCGNNAKEAMTAIAEACMLPWTAEQVVSMAFSQKNPKNQSETLNWLSNAIKEFGFSGLNVKAFISNVKTALAATNPAVRTAAITLLGVMYLYVGPSLRMFFEDEKPALLSQIDAEFEKMQGQSPPAPTRGISKHSTSGTDEGEDGDEPDDGSNDVVDLLPRTEISDKITSELVSKIGDKNWKIRKEGLDEVAGIINDAKFIQPNIGELPTALKGRLNDSNKILVQQTLNILQQLAVAMGPNIKQHVKNLGIPIITVLGDSKNNVRAAALATVNAWAEQTGMKEWLEGEDLSEELKKENPFLRQELLGWLAEKLPTLRSTPTDLILCVPHLYSCLEDRNGDVRKKAQDALPFFMMHLGYEKMAKATGKLKPTSKDQVLAMLEKAKVNMPAKPAPPTKATSKPMGGSAPAKFQPASAPAEDCISSSTEPKPDPKKAKAPGLSSKAKSAQGKKMPSKTSLKEDEDKSGPIFIVVPNGKEQRMKDEKGLKVLKWNFTTPRDEYIEQLKTQMSSCVAKWLQDEMFHSDFQHHNKALAVMVDHLESEKEGVIGCLDLILKWLTLRFFDTNTSVLMKALEYLKLLFTLLSEEEYHLTENEASSFIPYLVVKVGEPKDVIRKDVRAILNRMCLVYPASKMFPFIMEGTKSKNSKQRAECLEELGCLVESYGMNVCQPTPGKALKEIAVHIGDRDNAVRNAALNTIVTVYNVHGDQVFKLIGNLSEKDMSMLEERIKRSAKRPSAAPIKQVEEKPQRAQNISSNANMLRKGPAEDMSSKLNQARSMSGHPEAAQMVRREFQLDLDEIENDNGTVRCEMPELVQHKLDDIFEPVLIPEPKIRAVSPHFDDMHSNTASTINFIISQVASGDINTSIQALTQLFQIESLAREASTGVLKDLMHGLITLMLDSRIEDLEEGQQVIRSVNLLVVKVLEKSDQTNILSALLVLLQDSLLATASSPKFSELVMKCLWRMVRLLPDTINSINLDRILLDIHIFMKVFPKEKLKQCKSEFPIRTLKTLLHTLCKLKGPKILDHLTMIDNKNESELEAHLCRMMKHSMDQTGSKSDKETAKGASRIDAKSSKAKVNDFLAEIFKKIGSKENTKEGLAELYEYKKKYSDADIEPFLKNSSQFFQSYVERGLRVIEMEREGKGRISTSTGISPQMEVTCVPTPTSTVSSIGNTNGEEVGPSVYLERLKILRQRCGLDNTKQDDRPPLTSLLSKPAVPTVASSTDMLHSKLSQLRESREQHQHSDLDSNQTHSSGTVTSSSSTANIDDLKKRLERIKSSRK

SEQ ID NO: 372 - protein, 419 aa, Homo sapiens
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 373 - protein, 427 aa, Homo sapiens
MAPKKRPETQKTSEIVLRPRNKRSRSPLELEPEAKKLCAKGSGPSRRCDSDCLWVGLAGPQILPPCRSIVRTLHQHKLGRASWPSVQQGLQQSFLHTLDSYRILQKAAPFDRRATSLAWHPTHPSTVAVGSKGGDIMLWNFGIKDKPTFIKGIGAGGSITGLKFNPLNTNQFYASSMEGTTRLQDFKGNILRVFASSDTINIWFCSLDVSASSRMVVTGDNVGNVILLNMDGKELWNLRMHKKKVTHVALNPCCDWFLATASVDQTVKIWDLRQVRGKASFLYSLPHRHPVNAACFSPDGARLLTTDQKSEIRVYSASQWDCPLGLIPHPHRHFQHLTPIKAAWHPRYNLIVVGRYPDPNFKSCTPYELRTIDVFDGNSGKMMCQLYDPESSGISSLNEFNPMGDTLASAMGYHILIWSQEEARTRK

SEQ ID NO: 374 - protein, 146 aa, Homo sapiens [sequence omitted]

SEQ ID NO: 375 - protein, 471 aa, Homo sapiens
MAAMETETAPLTLESLPTDPLLLILSFLDYRDLINCCYVSRRLSQLSSHDPLWRRHCKKYWLISEEEKTQKNQCWKSLFIDTYSDVGRYIDHYAAIKKAWDDLKKYLEPRCPRMVLSLKEGAREEDLDAVEAQIGCKLPDDYRCSYRIHNGQKLVVPGLLGSMALSNHYRSEDLLDVDTAAGGFQQRQGLKYCLPLTFCIHTGLSQYIAVEAAEGRNKNEVFYQCPDQMARNPAAIDMFIIGATFTDWFTSYVKNVVSGGFPIIRDQIFRYVHDPECVATTGDITVSVSTSFLPELSSVHPPHYFFTYRIRIEMSKDALPEKACQLDSRYWRITNAKGDVEEVQGPGVVGEFPIISPGRVYEYTSCTTFSTTSGYMEGYYTFHFLYFKDKIFNVAIPRFHMACPTFRVSIARLEMGPDEYEEMEEEEEEEEEEDEDDDSADMDESDEDDEEERRRRVFDVPIRRRRCSRLF

SEQ ID NO: 376 - protein, 267 aa, Homo sapiens [sequence omitted]

SEQ ID NO: 377 - protein, 415 aa, Homo sapiens
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGNYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 378 - protein, 463 aa, Homo sapiens
MATVTATTKVPEIRDVTRIERIGAHSHIRGLGLDDALEPRQASQGMVGQLAARRAAGVVLEMIREGKIAGRAVLIAGQPGTGKTAIAMGMAQALGPDTPFTAIAGSEIFSLEMSKTEALTQAFRRSIGVRIKEETEIIEGEVVEIQIDRPATGTGSKVGKLTLKTTEMETIYDLGTKMIESLTKDKVQAGDVITIDKATGKISKLGRSFTRARDYDAMGSQTKFVQCPDGELQKRKEVVHTVSLHEIDVINSRTQGFLALFSGDTGEIKSEVREQINAKVAEWREEGKAEIIPGVLFIDEVHMLDIESFSFLNRALESDMAPVLIMATNRGITRIRGTSYQSPHGIPIDLLDRLLIVSTTPYSEKDTKQILRIRCEEEDVEMSEDAYTVLTRIGLETSLRYAIQLITAASLVCRKRKGTEVQVDDIKRVYSLFLDESRSTQYMKEYQDAFLFNELKGETMDTS

SEQ ID NO: 379 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 380 - protein, 759 aa, Homo sapiens
MAGLTLFVGRLPPSARSEQLEELFSQVGPVKQCFVVTEKGSKACRGFGYVTFSMLEDVQRALKEITTFEGCKINVTVAKKKLRNKTKEKGKNENSECPKKEPKAKKAKVADKKARLIIRNLSFKCSEDDLKTVFAQFGAVLEVNIPRKPDGKMRGFGFVQFKNLLEAGKALKGMNMKEIKGRTVAVDWAVAKDKYKDTQSVSAIGEEKSHESKHQESVKKKGREEEDMEEEENDDDDDDDDEEDGVFDDEDEEEENIESKVTKPVQIQKRAVKRPAPAKSSDHSEEDSDLEESDSIDDGEELAQSDTSTEEQEDKAVQVSNKKKRKLPSDVNEGKTVFIRNLSFDSEEEELGELLQQFGELKYVRIVLHPDTEHSKGCAFAQFMTQEAAQKCLLAASPENEAGGLKLDGRQLKVDLAVTRDEAAKLQTTKVKKPTGTRNLYLAREGLIRAGTKAAEGVSAADMAKRERFELLKHQKLKDQNIFVSRTRLCLHNLPKAVDDKQLRKLLLSATSGEKGVRIKECRVMRDLKGVHGNMKGQSLGYAFAEFQEHEHALKALRLINNNPEIFGPLKRPIVEFSLEDRRKLKMKELRIQRSLQKMRSKPATGEPQKGQPEPAKDQQQKAAQHHTEEQSKVPPEQKRKAGSTSWTGFQTKAEVEQVELPDGKKRRKVLALPSHRGPKIRLRDKGKVKPVHPKKPKPQINQWKQEKQQLSSEQVSRKKAKGNKTETRFNQLVEQYKRKLLGPSKGAPLAKRSKWFDS

SEQ ID NO: 381 - protein, 711 aa, Homo sapiens
MMADAKYVLCRWEKRLWPAKVLARTATSTKNKRRKEYFLAVQILSLEEKIKVKSTEVEILEKSQIEAIASSLASQNEVPAAPLEELAYRRSLRVALDVLSEGSIWSQESSAGTGRADRSLRGKPMEHVSSPCDSNSSSLPRGDVLGSSRPHRRRPCVQQSLSSSFTCEKDPECKVDHKKGLRKSENPRGPLVLPAGGGAQDESGSRIHHKNWTLASKRGGNSAQKASLCLNGSSLSEDDTERDMGSKGGSWAAPSLPSGVREDDPCANAEGHDPGLPLGSLTAPPAPEPSACSEPGECPAKKRPRLDGSQRPPAVQLEPMAAGAAPSPGPGPGPRESVTPRSTARLGPPPSHASADATRCLPCPDSQKLEKECQSSEESMGSNSMRSILEEDEEDEEPPRVLLYHEPRSFEVGMLVWHKHKKYPFWPAVVKSVRQRDKKASVLYIEGHMNPKMKGFTVSLKSLKHFDCKEKQTLLNQAREDFNQDIGWCVSLITDYRVRLGCGSFAGSFLEYYAADISYPVRKSIQQDVLGTKLPQLSKGSPEEPVVGCPLGQRQPCRKMLPDRSRAARDRANQKLVEYIVKAKGAESHLRAILKSRKPSRWLQTFLSSSQYVTCVETYLEDEGQLDLVVKYLQGVYQEVGAKVLQRTNGDRIRFILDVLLPEAIICAISAVDEVDYKTAEEKYIKGPSLSYREKEIFDNQLLEERNRRRR

SEQ ID NO: 382 - protein, 141 aa, Homo sapiens
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 383 - protein, 168 aa, Homo sapiens
MLPAALLRRPGLGRLVRHARAYAEAAAAPAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 384 - protein, 648 aa, Homo sapiens
MEGAGYRVVFEKGGVYLHTSAKKYQDRDSLIAGVIRVVEKDNDVLLHWAPVEEAGDSTQILFSKKDSSGGDSCASEEEPTFDPGYEPDWAVISTVRPQPCHSEPTRGAEPSCPQGSWAFSVSLGELKSIRRSKPGLSWAYLVLVTQAGGSLPALHFHRGGTRALLRVLSRYLLLASSPQDSRLYLVFPHDSSALSNSFHHLQLFDQDSSNVVSRFLQDPYSTTFSSFSRVTNFFRGALQPQPEGAASDLPPPPDDEPEPGFEVISCVELGPRPTVERGPPVTEEEWARHVGPEGRLQQVPELKNRIFSGGLSPSLRREAWKFLLGYLSWEGTAEEHKAHIRKKTDEYFRMKLQWKSVSPEQERRNSLLHGYRSLIERDVSRTDRTNKFYEGPENPGLGLLNDILLTYCMYHFDLGYVQGMSDLLSPILYVIQNEVDAFWCFCGFMELVQGNFEESQETMKRQLGRLLLLLRVLDPLLCDFLDSQDSGSLCFCFRWLLIWFKREFPFPDVLRLWEVLWTGLPGPNLHLLVACAILDMERDTLMLSGFGSNEILKHINELTMKLSVEDVLTRAEALHRQLTACPELPHNVQEILGLAPPAEPHSPSPTASPLPLSPTRAPPTPPPSTDTAPQPDSSLEILPEEEDEGADS

SEQ ID NO: 385 - protein, 158 aa, Homo sapiens [sequence omitted]

SEQ ID NO: 386 - protein, 271 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGWVCGVLPCRGPRRWHQECAAGFCRCCWSRSWFGISNKIALL

SEQ ID NO: 387 - protein, 510 aa, Homo sapiens
MYRALRLLARSRPLVRAPAAALASAPGLGGAAVPSFWPPNAARMASQNSFRIEYDTFGELKVPNDKYYGAQTVRSTMNFKIGGVTERMPTPVIKAFGILKRAAAEVNQDYGLDPKIANAIMKAADEVAEGKLNDHFPLVVWQTGSGTQTNMNVNEVISNRAIEMLGGELGSKIPVHPNDHVNKSQSSNDTFPTAMHIAAAIEVHEVLLPGLQKLHDALDAKSKEFAQIIKIGRTHTQDAVPLTLGQEFSGYVQQVKYAMTRIKAAMPRIYELAAGGTAVGTGLNTRIGFAEKVAAKVAALTGLPFVTAPNKFEALAAHDALVELSGAMNTTACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 388 - protein, 130 aa, Homo sapiens
MSGRGKQGGKARAKAKSRSSRAGLQFPVGRVHRLLRKGNYAERVGAGAPVYMAAVLEYLTAEILELAGNAARDNKKTRIIPRHLQLAIRNDEELNKLLGKVTIAQGGVLPNIQAVLLPKKTESHHKAKGK

SEQ ID NO: 389 - protein, 137 aa, Homo sapiens [sequence omitted]

SEQ ID NO: 390 - protein, 1087 aa, Homo sapiens
MSDSEDSNFSEEEDSERSSDGEEAEVDEERRSAAGSEKEEEPEDEEEEEEEEEYDEEEEEEDDDRPPKKPRHGGFILDEADVDDEYEDEDQWEDGAEDILEKEEIEASNIDNVVLDEDRSGARRLQNLWRDQREEELGEYYMKKYAKSSVGETVYGGSDELSDDITQQQLLPGVKDPNLWTVKCKIGEERATAISLMRKFIAYQFTDTPLQIKSVVAPEHVKGYIYVEAYKQTHVKQAIEGVGNLRLGYWNQQMVPIKEMTDVLKVVKEVANLKPKSWVRLKRGIYKDDIAQVDYVEPSQNTISLKMIPRIDYDRIKARMSLKDWFAKRKKFKRPPQRLFDAEKIRSLGGDVASDGDFLIFEGNRYSRKGFLFKSFAMSAVITEGVKPTLSELEKFEDQPEGIDLEVVTESTGKEREHNFQPGDNVEVCEGELINLQGKILSVDGNKITIMPKHEDLKDMLEFPAQELRKYFKMGDHVKVIAGRFEGDTGLIVRVEENFVILFSDLTMHELKVLPRDLQLCSETASGVDVGGQHEWGELVQLDPQTVGVIVRLERETFQVLNMYGKVVTVRHQAVTRKKDNRFAVALDSEQNNIHVKDIVKVIDGPHSGREGEIRHLFRSFAFLHCKKLVENGGMFVCKTRHLVLAGGSKPRDVTNFTVGGFAPMSPRISSPMHPSAGGQRGGFGSPGGGSGGMSRGRGRRDNELIGQTVRISQGPYKGYIGVVKDATESTARVELHSTCQTISVDRQRLTTVGSRRPGGMTSTYGRTPMYGSQTPMYGSGSRTPMYGSQTPLQDGSRTPHYGSQTPLHDGSRTPAQSGAWDPNNPNTPSRAEEEYEYAFDDEPTPSPQAYGGTPNPQTPGYPDPSSPQVNPQYNPQTPGTPAMYNTDQFSPYAAPSPQGSYQPSPSPQSYHQVAPSPAGYQNTHSPASYHPTPSPMAYQASPSPSPVGYSPMTPGAPSPGGYNPHTPGSGIEQNSSDWVTTDIQVKVRDTYLDTQVVGQTGVIRSVTGGMCSVYLKDSEKVVSISSEHLEPITPTKNNKVKVILGEDREATGVLLSIDGEDGIVRMDLDEQLKILNLRFLGKLLEA

SEQ ID NO: 391 - protein, 191 aa, Homo sapiens
MLSSIKCVLVGDSAVGKTSLLVRFTSETFPEAYKPTVYENTGVDVFMDGIQISLGLWDTAGNDAFRSIRPLSYQQADVVLMCYSVANHNSFLNLKNKWIGEIRSNLPCTPVLVVATQTDQREMGPHRASCVNAMEGKKLAQDVRAKGYLECSALSNRGVQQVFECAVRTAVNQARRRNRRRLFSINECKIF

SEQ ID NO: 392 - protein, 200 aa, Homo sapiens
MANIAVQRIKREFKEVLKSEETSKNQIKVDLVDENFTELRGEIAGPPDTPYEGGRYQLEIKIPETYPFNPPKVRFITKIWHPNISSVTGAICLDILKDQWAAAMTLRTVLLSLQALLAAAEPDDPQDAVVANQYKQNPEMFKQTARLWAHVYAGAPVSSPEYTKKIENLCAMGFDRNAVIVALSSKSWDVETATELLLSN

SEQ ID NO: 393 - protein, 522 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 394 - protein, 219 aa, Homo sapiens
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQLSPEQGSSGIEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 395 - protein, 183 aa, Homo sapiens
MSSPSPGKRRMDTDVVKLIESKHEVTILGGLNEFVVKFYGPQGTPYEGGVWKVRVDLPDKYPFKSPSIGFMNKIFHPNIDEASGTVCLDVINQTWTALYDLTNIFESFLPQLLAYPNPIDPLNGDAAAMYLHRPEEYKQKIKEYIQKYATEEALKEQEEGTGDSSSESSMSDFSEDEAQDMEL

SEQ ID NO: 396 - protein, 256 aa, Homo sapiens
MASGRPEELWEAVVGAAERFRARTGTELVLLTAAPPPPPRPGPCAYPAHGRGALAEAARRCLHDIALAHRAATAARPPAPPPAPQPPSPTPSPPRPTLAREDNEEDEDEPTETETSGEQLGISDNGGLFVMDEDATLQDLPPFCESDPESTDDGSLSEETPAGPPTCSVPPASALPTQQYAKSLPVSVPVWGFKEKRTEARSSDEENGPPSSPDLDRIAASMRALVLREAEDTQVFGDLPRPRLNTSDFQKLKRKY

SEQ ID NO: 397 - protein, 132 aa, Homo sapiens
MSMGDEGLQLAERVEISVYLDLCQLPLGLPMECKTPTLPGEASDARSIRRSAGLEIPGNTTMEGLAFGGGQSVAGWERQEWGLPLCWECRALPAHLPHASTRGRTSQLTILPGAFSRGARVTLAHTAIMMVL

SEQ ID NO: 398 - protein, 183 aa, Homo sapiens
MRLLSFVVLALFAVTQAEEGARLLASKSLLNRYAVEGRDLTLQYNIYNVGSSAALDVELSDDSFPPEDFGIVSGMLNVKWDRIAPASNVSHTVVLRPLKAGYFNFTSATITYLAQEDGPVVIGSTSAPGQGGILAQREFDRRFSPHFLDWAAFGVMTLPSIGIPLLLWYSSKRKYDTPKTKKN

SEQ ID NO: 399 - protein, 145 aa, Homo sapiens [sequence omitted]

SEQ ID NO: 400 - protein, 440 aa, Homo sapiens
MATRSCREKAQKLNEQHQLILSKLLREEDNKYCADCEAKGPRWASWNIGVFICIRCAGIHRNLGVHISRVKSVNLDQWTAEQIQCMQDMGNTKARLLYEANLPENFRRPQTDQAVEFFIRDKYEKKKYYDKNAIAITNKEKEKKKEEKKREKEPEKPAKPLTAEKLQKKDQQLEPKKSTSPKKAAEPTVDLLGLDGPAVAPVTNGNTTVPPLNDDLDIFGPMISNPLPATVMPPAQGTPSAPAAATLSTVTSGDLDLFTEQTTKSEEVAKKQLSKDSILSLYGTGTIQQQSTPGVFMGPTNIPFTSQAPAAFQGFPSMGVPVPAAPGLIGNVMGQSPSMMVGMPMPNGFMGNAQTGVMPLPQNVVGPQGGMVGQMGAPQSKFGLPQAQQPQWSLSQMNQQMAGMSISSATPTAGFGQPSSTTAGWSGSSSGQTLSTQLWK

SEQ ID NO: 401 - protein, 533 aa, Homo sapiens
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 402 - protein, 91 aa, Homo sapiens
MAANATTNPSQLLPLELVDKCIGSRIHIVMKSDKEIVGTLLGFDDFVNMVLEDVTEFEITPEGRRITKLDQILLNGNNITMLVPGGEGPEV

SEQ ID NO: 403 - protein, 1980 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVSSAVLGEPFQASKAGVRQGCEEAVSQVEPLPSLMKGLKRKEDQDRSPRRHGHEPAEDSDPLSRGDHPPDKRPVRLNRPRGGTLFGRTIQDVFKSNKEVGRLGNKEAKKETGFVESAESDHMAIPGGNQSVLAPSRIPGVNKEEETESREKKEDSLRGTPARQSNRSESTDSLGGLSPSEVTAIQCKNIPDYLNDRTILENHFGKIAKVQRIFTRRSKKLAVVHFFDHASAALARKKGKSLHKDMAIFWHRKKISPNKKPFSLKEKKPGDGEVSPSTEDAPFQHSPLGKAAGRTGASSLLNKSSPVKKPSLLKAHQFEGDSFDSASEGSEGLGPCVLSLSTLIGTVAETSKEKYRLLDQRDRIMRQARVKRTDLDKARTFVGTCLDMCPEKERYMRETRSQLSVFEVVPGTDQVDHAAAVKEYSRSSADQEEPLPHELRPLPVLSRTMDYLVTQIMDQKEGSLRDWYDFVWNRTRGIRKDITQQHLCDPLTVSLIEKCTRFHIHCAHFMCEEPMSSFDAKINNENMTKCLQSLKEMYQDLRNKGVFCASEAEFQGYNVLLSLNKGDILREVQQFHPAVRNSSEVKFAVQAFAALNSNNFVRFFKLVQSASYLNACLLHCYFSQIRKDALRALNFAYTVSTQRSTIFPLDGVVRMLLFRDCEEATDFLTCHGLTVSDGCVELNRSAFLEPEGLSKTRKSVFITRKLTVSVGEIVNGGPLPPVPRHTPVCSFNSQNKYIGESLAAELPVSTQRPGSDTVGGGRGEECGVEPDAPLSSLPQSLPAPAPSPVPLPPVLALTPSVAPSLFQLSVQPEPPPPEPVPMYSDEDLAQVVDELIQEALQRDCEEVGSAGAAYAAAALGVSNAAMEDLLTAATTGILRHIAAEEVSKERERREQERQRAEEERLKQERELVLSELSQGLAVELMERVMMEFVRETCSQELKNAVETDQRVRVARCCEDVCAHLVDLFLVEEIFQTAKETLQELQCFCKYLQRWREAVTARKKLRRQMRAFPAAPCCVDVSDRLRALAPSAECPIAEENLARGLLDLGHAGRLGISCTRLRRLRNKTAHQMKVQHFYQQLLSDVAWASLDLPSLVAEHLPGRQEHVFWKLVLVLPDVEEQSPESCGRILANWLKVKFMGDEGSVDDTSSDAGGIQTLSLFNSLSSKGDQMISVNVCIKVAHGALSDGAIDAVETQKDLLGASGLMLLLPPKMKSEDMAEEDVYWLSALLQLKQLLQAKPFQPALPLVVLVPSPGGDAVEKEVEDGLMLQDLVSAKLISDYTVTEIPDTINDLQGSTKVLQAVQWLVSHCPHSLDLCCQTLIQYVEDGIGHEFSGRFFHDRRERRLGGLASQEPGAIIELFNSVLQFLASVVSSEQLCDLSWPVTEFAEAGGSRLLPHLHWNAPEHLAWLKQAVLGFQLPQMDLPPLGAPWLPVCSMVVQYASQIPSSRQTQPVLQSQVENLLHRTYCRWKSKSPSPVHGAGPSVMEIPWDDLIALCINHKLRDWTPPRLPVTSEALSEDGQICVYFFKNDLKKYDVPLSWEQARLQTQKELQLREGRLAIKPFHPSANNFPIPLLHMHRNWKRSTECAQEGRIPSTEDLMRGASAEELLAQCLSSSLLLEKEENKRFEDQLQQWLSEDSGAFTDLTSLPLYLPQTLVSLSHTIEPVMKTSVTTSPQSDMMREQLQLSEATGTCLGERLKHLERLIRSSREEEVASELHLSALLDMVDI

SEQ ID NO: 404 - protein, 624 aa, Homo sapiens
MSDNQSWNSSGSEEDPETESGPPVERCGVLSKWTNYIHGWQDRWVVLKNNALSYYKSEDETEYGCRGSICLSKAVITPHDFDECRFDISVNDSVWYLRAQDPDHRQQWIDAIEQHKTESGYGSESSLRRHGSMVSLVSGASGYSATSTSSFKKGHSLREKLAEMETFRDILCRQVDTLQKYFDACADAVSKDELQRDKVVEDDEDDFPTTRSDGDFLHSTNGNKEKLFPHVTPKGINGIDFKGEAITFKATTAGILATLSHCIELMVKREDSWQKRLDKETEKKRRTEEAYKNAMTELKKKSHFGGPDYEEGPNSLINEEEFFDAVEAALDRQDKIEEQSQSEKVRLHWPTSLPSGDAFSSVGTHRFVQKPYSRSSSMSSIDLVSASDDVHRFSSQVEEMVQNHMTYSLQDVGGDANWQLVVEEGEMKVYRREVEENGIVLDPLKATHAVKGVTGHEVCNYFWNVDVRNDWETTIENFHVVETLADNAIIIYQTHKRVWPASQRDVLYLSVIRKIPALTENDPETWIVCNFSVDHDSAPLNNRCVRAKINVAMICQTLVSPPEGNQEISRDNILCKITYVANVNPGGWAPASVLRAVAKREYPKFLKRFTSYVQEKTAGKPILF

SEQ ID NO: 405 - protein, 439 aa, Homo sapiens
MPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 406 - protein, 906 aa, Homo sapiens
MAGNVKKSSGAGGGTGSGGSGSGGLIGLMKDAFQPHHHHHHHLSPHPPGTVDKKMVEKCWKLMDKVVRLCQNPKLALKNSPPYILDLLPDTYQHLRTILSRYEGKMETLGENEYFRVFMENLMKKTKQTISLFKEGKERMYEENSQPRRNLTKLSLIFSHMLAELKGIFPSGLFQGDTFRITKADAAEFWRKAFGEKTIVPWKSFRQALHEVHPISSGLEAMALKSTIDLTCNDYISVFEFDIFTRLFQPWSSLLRNWNSLAVTHPGYMAFLTYDEVKARLQKFIHKPGSYIFRLSCTRLGQWAIGYVTADGNILQTIPHNKPLFQALIDGFREGFYLFPDGRNQNPDLTGLCEPTPQDHIKVTQEQYELYCEMGSTFQLCKICAENDKDVKIEPCGHLMCTSCLTSWQESEGQGCPFCRCEIKGTEPIVVDPFDPRGSGSLLRQGAEGAPSPNYDDDDDERADDTLFMMKELAGAKVERPPSPFSMAPQASLPPVPPRLDLLPQRVCVPSSASALGTASKAASGSLHKDKPLPVPPTLRDLPPPPPPDRPYSVGAESRPQRRPLPCTPGDCPSRDKLPPVPSSRLGDSWLPRPIPKVPVSAPSSSDPWTGRELTNRHSLPFSLPSQMEPRPDVPRLGSTFSLDTSMSMNSSPLVGPECDHPKIKPSSSANAIYSLAARPLPVPKLPPGEQCEGEEDTEYMTPSSRPLRPLDTSQSSRACDCDQQIDSCTYEAMYNIQSQAPSITESSTFGEGNLAAAHANTGPEESENEDDGYDVPKPPVPAVLARRTLSDISNASSSFGWLSLDGDPTTNVTEGSQVPERPPKPFPRRINSERKAGSCQQGSGPAASAATASPQLSSEIENLMSQGYSYQDIQKALVIAQNNIEMAKNILREFVSISSPAHVAT

SEQ ID NO: 407 - protein, 223 aa, Homo sapiens [sequence omitted]

SEQ ID NO: 408 - protein, 188 aa, Homo sapiens [sequence omitted]

SEQ ID NO: 409 - protein, 822 aa, Homo sapiens
MAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 410 - protein, 422 aa, Homo sapiens
MQQPQPQGQQQPGPGQQLGGQGAAPGAGGGPGGGPGPGPCLRRELKLLESIFHRGHERFRIASACLDELSCEFLLAGAGGAGAGAAPGPHLPPRGSVPGDPVRIHCNITESYPAVPPIWSVESDDPNLAAVLERLVDIKKGNTLLLQHLKRIISDLCKLYNLPQHPDVEMLDQPLPAEQCTQEDVSSEDEDEEMPEDTEDLDHYEMKEEEPAEGKKSEDDGIGKENLAILEKIKKNQRQDYLNGAVSGSVQATDRLMKELRDIYRSQSFKGGNYAVELVNDSLYDWNVKLLKVDQDSALHNDLQILKEKEGADFILLNFSFKDNFPFDPPFVRVVSPVLSGGYVLGGGAICMELLTKQGWSSAYSIESVIMQISATLVKGKARVQFGANKSQYSLTRAQQSYKSLVQIHEKNGWYTPPKEDG

SEQ ID NO: 411 - protein, 399 aa, Homo sapiens
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGRVKTWKRRWFILTDNCLYYFEYTTDKEPRGIIPQENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 412 - protein, 460 aa, Homo sapiens
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 413 - protein, 670 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDVREGPDLDRPGSDRQERERARGDSEALDEES

SEQ ID NO: 414 - protein, 1382 aa, Homo sapiens
MGTGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNHIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTTTQGKLFFHYNPKLCLSEIHKMEEVSGTKGRQERNDIALKTNGDKASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 415 - protein, 1148 aa, Homo sapiens
MGQQPGKVLGDQRRPSLPALHFIKGAGKKESSRHGGPHCNVFVEQALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYPLSSGINGSFLVRESESSPSQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDRSQVYELLEKDYRMKRPEGCPEKVYELMRACWQWNPSDRPSFAEIHQAFETMFQESSISDEVEKELGKQGVRGAVTTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSVSCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAWKGSALGTPAAAEPVTPTSKAGSGAPRGTSKGPAEESRVRRHKHSSESPGRDKGKLSKLKPAPPPPPAASAGKAGGKPSQRPGQEAAGEAVLGAKTKATSLVDAVNSDAAKPSQPAEGLKKPVLPATPKPHPAKPSGTPISPAPVPLSTLPSASSALAGDQPSSTAFIPLISTRVSLRKTRQPPERASGAITKGVVLDSTEALCLAISGNSEQMASHSAVLEAGKNLYTFCVSYVDSIQQMRNKFAFREAINKLENNLRELQICPASAGSGPAATQDFSKLLSSVKEISDIVQR

SEQ ID NO: 416 - protein, 504 aa, Homo sapiens
MNQSIPVAPTPPRRVRLKPWLVAQVNSCQYPGLQWVNGEKKLFCIPWRHATRHGPSQDGDNTIFKAWAKETGKYTEGVDEADPAKWKANLRCALNKSRDFRLIYDGPRDMPPQPYKIYEVCSNGPAPTDSQPPEDYSFGAGEEEEEEEELQRMLPSLSLTDAVQSGPHMTPYSLLKEDVKWPPTLQPPTLQPPVVLGPPAPDPSPLAPPPGNPAGFRELLSEVLEPGPLPASLPPAGEQLLPDLLISPHMLPLTDLEIKFQYRGRPPRALTISNPHGCRLFYSQLEATQEQVELFGPISLEQVRFPSPEDIPSDKQRFYTNQLLDVLDRGLILQLQGQDLYAIRLCQCKVFWSGPCASAHDSCPNPIQREVKTKLFSLEHFLNELILFQKGQTNTPPPFEIFFCFGEEWPDRKPREKKLITVQVVPVAARLLLEMFSGELSWSADSIRLQISNPDLKDRMVEQFKELHHIWQSQQRLQPVAQAPPGAGLGVGQGPWPMHPAGMQ

SEQ ID NO: 417 - protein, 300 aa, Homo sapiens
MAAVAALQLGLRAAGLGRAPASAAWRSVLRVSPRPGVAWRPSRCGSSAAEASATKAEDDSFLQWVLLLIPVTAFGLGTWQVQRRKWKLNLIAELESRVLAEPVPLPADPMELKNLEYRPVKVRGCFDHSKELYMMPRTMVDPVREAREGGLISSSTQSGAYVVTPFHCTDLGVTILVNRGFVPRKKVNPETRQKGQIEGEVDLIGMVRLTETRQPFVPENNPERNHWHYRDLEAMARITGAEPIFIDANFQSTVPGGPIGGQTRVTLRNEHLQYIVTWYGLSAATSYLWFKKFLRGTPGV

SEQ ID NO: 418 - protein, 125 aa, Homo sapiens [sequence omitted]

SEQ ID NO: 419 - protein, 750 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPEPSMKIIADIFEYTAKHMPKFNSISISGYHMQEAGADAILELAYTLADGLEYSRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTNDVYDAALKLINEIEEMGGMAKAVAEGIPKLRIEECAARRQARIDSGSEVIVGVNKYQLEKEDAVEVLAIDNTSVRNRQIEKLKKIKSSRDQALAEHCLAALTECAASGDGNILALAVDASRARCTVGEITDALKKVFGEHKANDRMVSGAYRQEFGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 420 - protein, 433 aa, Homo sapiens
MEAVYLVVNGLGLVLDVLTLVLDLNFLLVSSLLASLAWLLAFVYNLPHTVLTSLLHLGRGVLLSLLALIEAVVRFTCGGLQALCTLLYSCCSGLESLKLLGHLASHGALRSREILHRGVLNVVSSGHALLRQACDICAIAMSLVAYVINSLVNICLIGTQNLFSLVLALWDAVTGPLWRMTDVVAAFLAHISSSAVAMAILLWTPCQLALELLASAARLLASFVLVNLTGLVLLACVLAVTVTVLHPDFTLRLATQALSQLHARPSYHRLREDVMRLSRLALGSEAWRRVWSRSLQLASWPNRGGAPGAPQGDPMRVFSVRTRRQDTLPEAGRRSEAEEEEARTIRVTPVRGRERLNEEEPPGGQDPWKLLKEQEERKKCVICQDQSKTVLLLPCRHLCLCQACTEILMRHPVYHRNCPLCRRGILQTLNVYL

SEQ ID NO: 421 - protein, 355 aa, Homo sapiens
MPFLGQDWRSPGQNWVKTADGWKRFLDEKSGSFVSDLSSYCNKEVYNKENLFNSLNYDVAAKKRKKDMLNSKTKTQYFHQEKWIYVHKGSTKERHGYCTLGEAFNRLDFSTAILDSRRFNYVVRLLELIAKSQLTSLSGIAQKNFMNILEKVVLKVLEDQQNIRLIRELLQTLYTSLCTLVQRVGKSVLVGNINMWVYRMETILHWQQQLNNIQITRPAFKGLTFTDLPLCLQLNIMQRLSDGRDLVSLGQAAPDLHVLSEDRLLWKKLCQYHFSERQIRKRLILSDKGQLDWKKMYFKLVRCYPRKEQYGDTLQLCKHCHILSWKGTDHPCTANNPESCSVSLSPQDFINLFKF

SEQ ID NO: 422 - protein, 623 aa, Homo sapiens
MSTQDERQINTEYAVSLLEQLKLFYEQQLFTDIVLIVEGTEFPCHKMVLATCSSYFRAMFMSGLSESKQTHVHLRNVDAATLQIIITYAYTGNLAMNDSTVEQLYETACFLQVEDVLQRCREYLIKKINAENCVRLLSFADLFSCEELKQSAKRMVEHKFTAVYHKDAFMQLSHDLLIDILSSDNLNVEKEETVREAAMLWLEYNTESRSQYLSSVLSQIRIDALSEVTQRAWFQGLPPNDKSVVVQGLYKSMPKFFKPRLGMTKEEMMIFIEASSENPCSLYSSVCYSPQAEKVYKLCSPPADLHKVGTVVTPDNDIYIAGGQVPLKNTKTNHSKTSKLQTAFRTVNCFYWFDAQQNTWFPKTPMLFVRIKPSLVCCEGYIYAIGGDSVGGELNRRTVERYDTEKDEWTMVSPLPCAWQWSAAVVVHDCIYVMTLNLMYCYFPRSDSWVEMAMRQTSRSFASAAAFGDKIFYIGGLHIATNSGIRLPSGTVDGSSVTVEIYDVNKNEWKMAANIPAKRYSDPCVRAVVISNSLCVFMRETHLNERAKYVTYQYDLELDRWSLRQHISERVLWDLGRDFRCTVGKLYPSCLEEYPWKPPTYLFSTDGTEEFELDGEMVALPPV

SEQ ID NO: 423 - protein, 570 aa, Homo sapiens
MAFRGWRPPPPPLLLLLLWVTGQAAPVAGLGSDAELQIERRFVPDECPRTVRSGDFVRYHYVGTFPDGQKFDSSYDRDSTFNVFVGKGQLITGMDQALVGMCVNERRFVKIPPKLAYGNEGVSGVIPPNSVLHFDVLLMDIWNSEDQVQIHTYFKPPSCPRTIQVSDFVRYHYNGTFLDGTLFDSSHNRMKTYDTYVGIGWLIPGMDKGLLGMCVGEKRIITIPPFLAYGEDGDGKDIPGQASLVFDVALLDLHNPKDSISIENKVVPENCERISQSGDFLRYHYNGTLLDGTLFDSSYSRNRTFDTYIGQGYVIPGMDEGLLGVCIGEKRRIVVPPHLGYGEEGRGNIPGSAVLVFDIHVIDFHNPSDSISITSHYKPPDCSVLSKKGDYLKYHYNASLLDGTLLDSTWNLGKTYNIVLGSGQVVLGMDMGLREMCVGEKRTVIIPPHLGYGEAGVDGEVPGSAVLVFDIELLELVAGLPEGYMFIWNGEVSPNLFEEIDKDGNGEVLLEEFSEYIHAQVASGKGKLAPGFDAELIVKNMFTNQDRNGDGKVTAEEFKLKDQEAKHDEL

SEQ ID NO: 424 - protein, 218 aa, Homo sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWVRLLKPPHPHHRALTTAPAPPSLPPATPLGPWAFWSRSQWCPLPIFRSSDVVYNAFSLRV

SEQ ID NO: 425 - protein, 105 aa, Homo sapiens [sequence omitted]

SEQ ID NO: 426 - protein, 554 aa, Homo sapiens
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 427 - protein, 1394 aa, Homo sapiens
MHSSNPKVRSSPSGNTQSSPKSKQEVMVRPPTVMSPSGNPQLDSKFSNQGKQGGSASQSQPSPCDSKSGGHTPKALPGPGGSMGLKNGAGNGAKGKGKRERSISADSFDQRDPGTPNDDSDIKECNSADHIKSQDSQHTPHSMTPSNATAPRSSTPSHGQTTATEPTPAQKTPAKVVYVFSTEMANKAAEAVLKGQVETIVSFHIQNISNNKTERSTAPLNTQISALRNDPKPLPQQPPVPANQDQNSSQNTRLQPTPPIPAPAPKPAAPPRPLDRESPGVENKLIPSVGSPASSTPLPPDGTGPNSTPNNRAVTPVSQGSNSSSADPKAPPPPPVSSGEPPTLGENPDGLSQEQLEHRERSLQTLRDIQRMLFPDEKEFTGAQSGGPQQNPGVLDGPQKKPEGPIQAMMAQSQSLGKGPGPRTDVGAPFGPQGHRDVPFSPDEMVPPSMNSQSGTIGPDHLDHMTPEQIAWLKLQQEFYEEKRRKPEQVVVQQCSLQDMMVHQHGPRGVVRGPPPPYQMTPSEGWAPGGTEPFSDGINMPHSLPPRGMAPHPNMPGSQMRLPGFAGMINSEMEGPNVPNPASRPGLSGVSWPDDVPKIPDGRNFPPGRGIFSGPGRGERFPNPQGLSEEMFQQQLAEKQLGLPPGMAMEGIRPSMEMNRMIPGSQRHMEPGNNPIFPRIPVEGPLSPSRGDFPKGIPPQMGPGRELEFGMVPSGMKGDVNLNVNMGSNSQMIPQKMREAGAGPEEMLKLRPGGSDMLPAQQKMVPLPFGEHPQQEYGMGPRPFLPMSQGPGSNSGLRNLREPIGPDQRTNSRLSHMPPLPLNPSSNPTSLNTAPPVQRGLGRKPLDISVAGSQVHSPGINPLKSPTMHQVQSPMLGSPSGNLKSPQTPSQLAGMLAGPAAAASIKSPPVLGSAAASPVHLKSPSLPAPSPGWTSSPKPPLQSPGIPPNHKAPLTMASPAMLGNVESGGPPPPTASQPASVNIPGSLPSSTPYTMPPEPTLSQNPLSIMMSRMSKFAMPSSTPLYHDAIKTVASSDDDSPPARSPNLPSMNNMPGMGINTQNPRISGPNPVVPMPTLSPMGMTQPLSHSNQMPSPNAVGPNIPPHGVPMGPGLMSHNPIMGHGSQEPPMVPQGRMGFPQGFPPVQSPPQQVPFPHNGPSGGQGSFPGGMGFPGEGPLGRPSNLPQSSADAALCKPGGPGGPDSFTVLGNSMPSVFTDPDLQEVIRPGATGIPEFDLSRIIPSEKPSQTLQYFPRGEVPGRKQPQGPGPGFSHMQGMMGEQAPRMGLALPGMGGPGPVGTPDIPLGTAPSMPGHNPMRPPAFLQQGMMGPHHRMMSPAQSTMPGQPTLMSNPAAAVGMIPGKDRGPAGLYTHPGPVGSPGMMMSMQGMMGPNRTS

SEQ ID NO: 428 - protein, 311 aa, Homo sapiens [sequence omitted]

SEQ ID NO: 429 - protein, 236 aa, Homo sapiens
MARPLVPSSQKALLLELKGLQEEPVEGFRVTLVDEGDLYNWEVAIFGPPNTYYEGGYFKARLKFPIDYPYSPPAFRFLTKMWHPNIYETGDVCISILHPPVDDPQSGELPSERWNPTQNVRTILLSVISLLNEPNTFSPANVDASVMYRKWKESKGKDREYTDIIRKQVLGTKVDAERDGVKVPTTLAEYCVKTKAPAPDEGSDLFYDDYYEDGEVEEEADSCFGDDEDDSGTEES

SEQ ID NO: 430 - protein, 423 aa, Homo sapiens [sequence omitted]

SEQ ID NO: 431 - protein, 532 aa, Homo sapiens
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTREVTVNVLSPRYEIVIITVVAAAVIMGTAGLSTYLYNRQRKIKKYRLQQAQKGTPMKPNTQATPP

SEQ ID NO: 432 - protein, 251 aa, Homo sapiens
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 433 - protein, 354 aa, Homo sapiens
MCYVPSPVLASVGDTDDRFEDLEEANPFSFREFLKTKNLGLSKEDPASRIYAKEASRHSLGLDHNSPPSQTGGYGLEYQQPFFEDPTGAGDLLDGEEDEDTGWSGAYLPSAIEQTHPERVPAGTSPCSTYLSFFSTPSELAGPESLPSWALSDTDSRVSPASPAGSPSADFAVHGESLGDRHLRTLQISYDALKDENSKLRRKLNEVQSFSEAQTEMVRTLERKLEAKMIKEESDYHDLESVVQQVEQNLELMTKRAVKAENHVVKLKQEISLLQAQVSNFQRENEALRCGQGASLTVVKQNADVALQNLRVVMNSAQASIKQLVSGAETLNLVAEILKSIDRISEIKDEEEDS

SEQ ID NO: 434 - protein, 312 aa, Homo sapiens
MSAFSEAALEKKLSELSNSQQSVQTLSLWLIHHRKHSRPIVTVWERELRKAKPNRKLTFLYLANDVIQNSKRKGPEFTKDFAPVIVEAFKHVSSETDESCKKHLGRVLSIWEERSVYENDVLEQLKQALYGDKKPRKRTYEQIKVDENENCSSLGSPSEPPQTLDLVRALQDLENAASGDAAVHQRIASLPVEVQEVSLLDKITDKESGERLSKMVEDACMLLADYNGRLAAEIDDRKQLTRMLADFLRCQKEALAEKEHKLEEYKRKLARVSLVRKELRSRIQSLPDLSRLPNVTGSHMHLPFAGDIYSED

SEQ ID NO: 435 - protein, 128 aa, Homo sapiens
MAGGKAGKDSGKAKTKAVSRSQRAGLQFPVGRIHRHLKSRTTSHGRVGATAAVYSAAILEYLTAEVLELAGNASKDLKVKRITPRHLQLAIRGDEELDSLIKATIAGGGVIPHIHKSLIGKKGQQKTV

SEQ ID NO: 436 - protein, 547 aa, Homo sapiens
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYGLPERVELAPLPPWQPVGQNFTLRCQVEGGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 437 - protein, 85 aa, Homo sapiens
MLRRKPTRLELKLDDIEEFENIRKDLETRKKQKEDVEVVGGSDGEGAIGLSSDPKSREQMINDRIGYKPQPKPNNRSSQFGSLEF

SEQ ID NO: 438 - protein, 213 aa, Homo sapiens
MAVLSAPGLRGFRILGLRSSVGLAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 439 - protein, 380 aa, Homo sapiens
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 440 - protein, 546 aa, Homo sapiens
MRPEPLWLDMLGIQGASGRSSPSGCLPPSSALPSGTRSLPRPIDGVSDWSQGCSLRSTGSPASLASNLEISQSPTMPFLSLHRSPHGPSKLCDDPQASLVPEPVPGGCQEPEEMSWPPSGEIASPPELPSSPPPGLPEVAPDATSTGLPDTPAAPETSTNYPVECTEGSAGPQSLPLPILEPVKNPCSVKDQTPLQLSVEDTTSPNTKPCPPTPTTPETSPPPPPPPPSSTPCSAHLTPSSLFPSSLESSSEQKFYNFVILHARADEHIALRVREKLEALGVPDGATFCEDFQVPGRGELSCLQDAIDHSAFIILLLTSNFDCRLSLHQVNQAMMSNLTRQGSPDCVIPFLPLESSPAQLSSDTASLLSGLVRLDEHSQIFARKVANTFKPHRLQARKAMWRKEQDTRALREQSQHLDGERMQAAALNAAYSAYLQSYLSYQAQMEQLQVAFGSHMSFGTGAPYGARMPFGGQVPLGAPPPFPTWPGCPQPPPPPAFPTASPAPPQSPGLQPLIIHHAQMVQLGLNNHMWNQRGSQAPEDKTQEAE

SEQ ID NO: 441 - protein, 148 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGLKLRGKDIGKPIEKGPRAK

SEQ ID NO: 442 - protein, 1324 aa, Homo sapiens
MADSLYNIRLLREFSNEYLNKCFYLTLEDMLYAPLVLKPNVMVFIAELFWWFENVKPDFVQPRDVQELKDAKTVLHQKSSRPPVPISNATKRSFLGSPAAGTLAELQPPVQLPAEGCHRHYLHPEEPEYLGKGTAAFSPSHPLLPLRQKQQKSIQGEDIPDQRHRSNSLTRVDGQPRGAAIAWPEKKTRPASQPTPFALHHAASCEVDPSSGDSISLARSISKDSLASNIVNLTPQNQPHPTATKSHGKSLLSNVSIEDEEEELVAIVRADVVPQQADPEFPRASPRALGLTANARSPQGQLDTSESKPDSFFLEPLMPAVLKPAKEKQVITKEDERGEGRPRSIVSRRPSEGPQPLVRRKMTGSRDLNRTFTPIPCSEFPMGIDPTETGPLSVETAGEVCGGPLALGGFDPFPQGPSTDGFFLHVGRADEDTEGRLYVSCSKSPNSHDSEPWTLLRQDSDSDVVDIEEAEHDFMGEAHPVVFSRYIGEEESAKLQEDMKVKEHEDKDDASGRSSPCLSTASQMSSVSMASGSVKMTSFAERKLQRLNSCETKSSTSSSQKTTPDASESCPAPLTTWRQKREQSPSQHGKDPASLLASELVQLHMQLEEKRRAIEAQKKKMEALSARQRLKLGKAAFLHVVKKGKAEAAPPLRPEHFAKEYSQHNGEDCGDAVSKTEDFLVKEEQREELLHEPQDVDKESLAFAQQHKAKDPVALHELERNKVISAALLEDTVGEVVDVNECDLSIEKLNETISTLQQAILKISQQQEQLLMKSPTVPVPGSKNNSQDHKVKAPVHFVEPLSPTGVAGHRKAPRLGQGRNSRSGRPAELKVPKDRPQGSSRSKTPTPSVETLPHLRPFPASSHPRTPTDPGLDSALEPSGDPHGKCLFDSYRLHDESNQRTLTLSSSKDANILSEQMSLKEVLDASVKEVGSSSSDVSGKESVPVEEPLRSRASLIEVDLSDLKAPDEDGELVSLDGSADLVSEGDQKPGVGFFFKDEQKAEDELAKKRAAFLLKQQRKAEEARVRKQQLEAEVELKRDEARRKAEEDRVRKEEEKARRELIKQEYLRRKQQQILEEQGLGKPKSKPKKPRPKSVHREESCSDSGTKCSSTPDNLSRTQSGSSLSLASAATTEPESVHSGGTPSQRVESMEALPILSRNPSRSTDRDWETASAASSLASVAEYTGPKLFKEPSSKSNKPIIHNAISHCCLAGKVNEPHKNSILEELEKCDANHYIILFRDAGCQFRALYCYYPDTEEIYKLTGTGPKNITKKMIDKLYKYSSDRKQFNLIPAKTMSVSVDALTIHNHLWQPKRPAVPKKAQTRK

SEQ ID NO: 443 - protein, 409 aa, Homo sapiens
MEEGGSTGSAGSDSSTSGSGGAQQRELERMAEVLVTGEQLRLRLHEEKVIKDRRHHLKTYPNCFVAKELIDWLIEHKEASDRETAIKLMQKLADRGIIHHVCDEHKEFKDVKLFYRFRKDDGTFPLDNEVKAFMRGQRLYEKLMSPENTLLQPREEEGVKYERTFMASEFLDWLVQEGEATTRKEAEQLCHRLMEHGIIQHVSSKHPFVDSNLLYQFRMNFRRRRRLMELLNEKSPSSQETHDSPFCLGKQSHDNRKSTSFMSVSPSKEIKIVSAVRRSSMSSCGSSGYFSSSPTLSSSPPVLCNPKSVLKRPVTSEELLTPGAPYARKTFTIVGDAVGWGFVVRGSKPCHIQAVDPSGPAAAAGMKVCQFVVSVNGLNVLHVDYRTVSNLILTGPRTIVMEVMEELEC

SEQ ID NO: 444 - protein, 806 aa, Homo sapiens
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGFNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 445 - protein, 858 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVEDMMKKLWGDRYFDPANGKFSKSATSPEGKKLPRTFCQLILDPIFKVFDAIMNFKKEETAKLIEKLDIKLDSEDKDKEGKPLLKAVMRRWLPAGDALLQMITIHLPSPVTAQKYRCELLYEGPPDDEAAMGIKSCDPKGPLMMYISKMVPTSDKGRFYAFGRVFSGLVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQCIIEESGEHIIAGAGELHLEICLKDLEEDHACIPIKKSDPVVSYRETVSEESNVLCLSKSPNKHNRLYMKARPFPDGLAEDIDKGEVSARQELKQRARYLAEKYEWDVAEARKIWCFGPDGTGPNILTDITKGVQYLNEIKDSVVAGFQWATKEGALCEENMRGVRFDVHDVTLHADAIHRGGGQIIPTARRCLYASVLTAQPRLMEPIYLVEIQCPEQVVGGIYGVLNRKRGHVFEESQVAGTPMFVVKAYLPVNESFGFTADLRSNTGGQAFPQCVFDHWQILPGDPFDNSSRPSQVVAETRKRKGLKEGIPALDNFLDKL

SEQ ID NO: 446 - protein, 396 aa, Homo sapiens
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLESLGKNLDGKLRVIHCDFFKLDPRSGGVIKPPAMSSRGLFKNLGIEAVPWTADIPLKVVGMFPSRGEKRALWKLAYDLYSCTSIYKFGRIEVNMFIGEKEFQKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 447 - protein, 468 aa, Homo sapiens
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 448 - protein, 479 aa, Homo sapiens
MSDGFDRAPGAGRGRSRGLGRGGGGPEGGGFPNGAGPAERARHQPPQPKAPGFLQPPPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 449 - protein, 256 aa, Homo sapiens
MSELPGDVRAFLREHPSLRLQTDARKVRCILTGHELPCRLPELQVYTRGKKYQRLVRASPAFDYAEFEPHIVPSTKNPHQLFCKLTLRHINKCPEHVLRHTQGRRYQRALCKYEECQKQGVEYVPACLVHRRRRREDQMDGDGPRPREAFWEPTSSDEGGAASDDSMTDLYPPELFTRKDLGSTEDGDGTDDFLTDKEDEKAKPPREKATDEGRRETTVYRGLVQKRGKKQLGSLKKKFKSHHRKPKSFSSCKQPG

SEQ ID NO: 450 - protein, 135 aa, Homo sapiens
MRGKTFRFEMQRDLVSFPLSPAVRVKLVSAGFQTAEELLEVKPSELSKEVGISKAEALETLQIIRRECLTNKPRYAGTSESHKKCTALELLEQEHTQGFIITFCSALDDILGGGVPLMKTTEICGAPGVGKTQLW

SEQ ID NO: 451 - protein, 338 aa, Homo sapiens
MSDFDSNPFADPDLNNPFKDPSVTQVTRNVPPGLDEYNPFSDSRTPPPGGVKMPNVPNTQPAIMKPTEEHPAYTQIAKEHALAQAELLKRQEELERKAAELDRREREMQNLSQHGRKNNWPPLPSNFPVGPCFYQDFSVDIPVEFQKTVKLMYYLWMFHAVTLFLNIFGCLAWFCVDSARAVDFGLSILWFLLFTPCSFVCWYRPLYGAFRSDSSFRFFVFFFVYICQFAVHVLQAAGFHNWGIGGWISSLTGLNQNIPVGIMMIIIAALFTASAVISLVMFKKVHGLYRTTGASFEKAQQEFATGVMSNKTVQTAAANAASTAASSAAQNAFKGNQI

SEQ ID NO: 452 - protein, 1599 aa, Homo sapiens
MNKAPQSTGPPPAPSPGLPQPAFPPGQTAPVVFSTPQATQMNTPSQPRQHFYPSRAQPPSSAASRVQSAAPARPGPAAHVYPAGSQVMMIPSQISYPASQGAYYIPGQGRSTYVVPTQQYPVQPGAPGFYPGASPTEFGTYAGAYYPAQGVQQFPTGVAPAPVLMNQPPQIAPKRERKTIRIRDPNQGGKDITEEIMSGARTASTPTPPQTGGGLEPQANGETPQVAVIVRPDDRSQGAIIADRPGLPGPEHSPSESQPSSPSPTPSPSPVLEPGSEPNLAVLSIPGDTMTTIQMSVEESTPISRETGEPYRLSPEPTPLAEPILEVEVTLSKPVPESEFSSSPLQAPTPLASHTVEIHEPNGMVPSEDLEPEVESSPELAPPPACPSESPVPIAPTAQPEELLNGAPSPPAVDLSPVSEPEEQAKEVTASMAPPTIPSATPATAPSATSPAQEEEMEEEEEEEEGEAGEAGEAESEKGGEELLPPESTPIPANLSQNLEAAAATQVAVSVPKRRRKIKELNKKEAVGDLLDAFKEANPAVPEVENQPPAGSNPGPESEGSGVPPRPEEADETWDSKEDKIHNAENIQPGEQKYEYKSDQWKPLNLEEKKRYDREFLLGFQFIFASMQKPEGLPHISDVVLDKANKTPLRPLDPTRLQGINCGPDFTPSFANLGRTTLSTRGPPRGGPGGELPRGPAGLGPRRSQQGPRKEPRKIIATVLMTEDIKLNKAEKAWKPSSKRTAADKDRGEEDADGSKTQDLFRRVRSILNKLTPQMFQQLMKQVTQLAIDTEERLKGVIDLIFEKAISEPNFSVAYANMCRCLMALKVPTTEKPTVTVNFRKLLLNRCQKEFEKDKDDDEVFEKKQKEMDEAATAEERGRLKEELEEARDIARRRSLGNIKFIGELFKLKMLTEAIMHDCVVKLLKNHDEESLECLCRLLTTIGKDLDFEKAKPRMDQYFNQMEKIIKEKKTSSRIRFMLQDVLDLRGSNWVPRRGDQGPKTIDQIHKEAEMEEHREHIKVQQLMAKGSDKRRGGPPGPPISRGLPLVDDGGWNTVPISKGSRPIDTSRLTKITKPGSIDSNNQLFAPGGRLSWGKGSSGGSGAKPSDAASEAARPATSTLNRFSALQQAVPTESTDNRRVVQRSSLSRERGEKAGDRGDRLERSERGGDRGDRLDRARTPATKRSFSKEVEERSRERPSQPEGLRKAASLTEDRDRGRDAVKREAALPPVSPLKAALSEEELEKKSKAIIEEYLHLNDMKEAVQCVQELASPSLLFIFVRHGVESTLERSAIAREHMGQLLHQLLCAGHLSTAQYYQGLYEILELAEDMEIDIPHVWLYLAELVTPILQEGGVPMGELFREITKPLRPLGKAASLLLEILGLLCKSMGPKKVGTLWREAGLSWKEFLPEGQDIGAFVAEQKVEYTLGEESEAPGQRALPSEELNRQLEKLLKEGSSNQRVFDWIEANLSEQQIVSNTLVRALMTAVCYSAIIFETPLRVDVAVLKARAKLLQKYLCDEQKELQALYALQALVVTLEQPPNLLRMFFDALYDEDVVKEDAFYSWESSKDPAEQQGKGVALKSVTAFFKWLREAEEESDHN

SEQ ID NO: 453 - protein, 1647 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 454 - protein, 1230 aa, Homo sapiens
MSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCFFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEELGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 455 - protein, 760 aa, Homo sapiens
MSTVEEDSDTVTVETVNSVTLTQDTEGNLILHCPQNEADEIDSEDSIEPPHKRLCLSSEDDQSIDDSTPCISVVALPLSENDQSFEVTMTATTEVADDEVTEGTVTQIQILQNEQLDEISPLGNEEVSAVSQAWFTTKEDKDSLTNKGHKWKQGMWSKEEIDILMNNIERYLKARGIKDATEIIFEMSKDERKDFYRTIAWGLNRPLFAVYRRVLRMYDDRNHVGKYTPEEIEKLKELRIKHGNDWATIGAALGRSASSVKDRCRLMKDTCNTGKWTEEEEKRLAEVVHELTSTEPGDIVTQGVSWAAVAERVGTRSEKQCRSKWLNYLNWKQSGGTEWTKEDEINLILRIAELDVADENDINWDLLAEGWSSVRSPQWLRSKWWTIKRQIANHKDVSFPVLIKGLKQLHENQKNNPTLLENKSGSGVPNSNTNSSVQHVQIRVARLEDNTAISSSPMAALQIPVQITHVSSADSPATVDSETITLNSGTLQTFEILPSFHLQPTGTPGTYLLQTSSSQGLPLTLTASPTVTLTAAAPASPEQIIVHALSPEHLLNTSDNVTVQCHTPRVIIQTVATEDITSSISQAELTVDSDIQSSDFPEPPDALEADTFPDEIHHPKMTVEPSFNDAHVSKFSDQNSTELMNSVMVRTEEEISDTDLKQEESPSDLASAYVTEGLESPTIEEQVDQTIDDETILIVPSPHGFIQASDVIDTESVLPLTTLTDPILQHHQEESNIIGSSLGSPVSEDSKDVEDLVNCH

SEQ ID NO: 456 - protein, 437 aa, Homo sapiens
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 457 - protein, 800 aa, Homo sapiens
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNDNAPAFTQTSYTLFVRENNSPALHIGSVSATDRDSGTNAQVTYSLLPPQDPHLPLASLVSINADNGHLFALRSLDYEALQAFEFRVGATDRGSPALSREALVRVLVLDANDNSPFVLYPLQNGSAPCTELVPRAAEPGYLVTKVVAVDGDSGQNAWLSYQLLKATEPGLFGVWAHNGEVRTARLLSERDAAKHRLVVLVKDNGEPPRSATATLHLLLVDGFSQPYLPLPEAAPAQAQAEADLLTVYLVVALASVSSLFLLSVLLFVAVRLCRRSRAASVGRCSVPEGPFPGHLVDVRGAETLSQSYQYEVCLTGGPGTSEFKFLKPVISDIQAQGPGRKGEENSTFRNSFGFNIQ

SEQ ID NO: 458 - protein, 414 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 459 - protein, 709 aa, Homo sapiens
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 460 - protein, 1215 aa, Homo sapiens
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGVWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRGILVKLMEWEPGREEINAFSWSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 461 - protein, 227 aa, Homo sapiens
MTDFKLGIVRLGRVAGKTKYTLIDEQDIPLVESYSFEARMEVDADGNGAKIFAYAFDKNRGRGSGRLLHELLWERHRGGVAPGFQVVHLNAVTVDNRLDNLQLVPWGWRPKAEETSSKQREQSLYWLAIQQLPTDPIEEQFPVLNVTRYYNANGDVVEEEENSCTYYECHYPPCTVIEKQLREFNICGRCQVARYCGSQCQQKDWPAHKKHCRERKRPFQHELEPER

SEQ ID NO: 462 - protein, 264 aa, Homo sapiens
MEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYRDARSYNRFQIATVTEKGVEIEGPLSTETNWDIAHMISGFE

SEQ ID NO: 463 - protein, 367 aa, Homo sapiens
MAAEEEDEVEWVVESIAGFLRGPDWSIPILDFVEQKCEVNCKGGHVITPGSPEPVILVACVPLVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKGLKIPGLEHASIEGPIANLSVLGTEELRQREHYLKQKRDKLMSMRKDMRTKQIQNMEQKGKPTGEVEEMTEKPEMTAEEKQTLLKRRLLAEKLKEEVINK

SEQ ID NO: 464 - protein, 432 aa, Homo sapiens
MAAPMEVAVCTDSAAPMWSCIVWELHSGANLLTYRGGQAGPRGLALLNGEYLLAAQLGKNYISAWELQRKDQLQQKIMCPGPVTCLTASPNGLYVLAGVAESIHLWEVSTGNLLVILSRHYQDVSCLQFTGDSSHFISGGKDCLVLVWSLCSVLQADPSRIPAPRHVWSHHTLPITDLHCGFGGPLARVATSSLDQTVKLWEVSSGELLLSVLFDVSIMAVTMDLAEHHMFCGGSEGSIFQVDLFTWPGQRERSFHPEQDAGKVFKGHRNQVTCLSVSTDGSVLLSGSHDETVRLWDVQSKQCIRTVALKGPVTNAAILLAPVSMLSSDFRPSLPLPHFNKHLLGAEHGDEPRHGGLTLRLGLHQQGSEPSYLDRTEQLQAVLCSTMEKSVLGGQDQLRVRVTELEDEVRNLRKINRDLFDFSTRFITRPAK

SEQ ID NO: 465 - protein, 472 aa, Homo sapiens
MGLSSQNGQLRGPVKPTGGPGGGGTQTQQQMNQLKNTNTINNGTQQQAQSMTTTIKPGDDWKKTLKLPPKDLRIKTSDVTSTKGNEFEDYCLKRELLMGIFEMGWEKPSPIQEESIPIALSGRDILARAKNGTGKSGAYLIPLLERLDLKKDNIQAMVIVPTRELALQVSQICIQVSKHMGGAKVMATTGGTNLRDDIMRLDDTVHVVIATPGRILDLIKKGVAKVDHVQMIVLDEADKLLSQDFVQIMEDIILTLPKNRQILLYSATFPLSVQKFMNSHLQKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 466 - protein, 474 aa, Homo sapiens
MNSVSPAAAQYRSSSPEDARRRPEARRPRGPRGPDPNGLGPSGASGPALGSPGAGPSEPDEVDKFKAKFLTAWNNVKYGWVVKSRTSFSKISSIHLCGRRYRFEGEGDIQRFQRDFVSRLWLTYRRDFPPLPGGCLTSDCGWGCMLRSGQMMLAQGLLLHFLPRDWTWAEGMGLGPPELSGSASPSRYHGPARWMPPRWAQGAPELEQERRHRQIVSWFADHPRAPFGLHRLVELGQSSGKKAGDWYGPSLVAHILRKAVESCSDVTRLVVYVSQDCTVYKADVARLVARPDPTAEWKSVVILVPVRLGGETLNPVYVPCVKELLRCELCLGIMGGKPRHSLYFIGYQDDFLLYLDPHYCQPTVDVSQADFPLESFHCTSPRKMAFAKMDPSCTVGFYAGDRKEFETLCSELTRVLSSSSATERYPMFTLAEGHAQDHSLDDLCSQLAQPTLRLPRTGRLLRAKRPSSEDFVFL

SEQ ID NO: 467 - protein, 499 aa, Homo sapiens
MSLADELLADLEEAAEEEEGGSYGEEEEEPAIEDVQEETQLDLSGDSVKTIAKLWDSKMFAEIMMKIEEYISKQAKASEVMGPVEAAPEYRVIVDANNLTVEIENELNIIHKFIRDKYSKRFPELESLVPNALDYIRTVKELGNSLDKCKNNENLQQILTNATIMVVSVTASTTQGQQLSEEELERLDEACDMALELNASKHRIYEYVESRMSFIAPNLSIIIGASTAAKIMGVAGGLTNLSKMPACNIMLLGAQRKTLSGFSSTSVLPHTGYIYHSDIVQSLPPDLRRKAARLVAAKCTLAARVDSFHESTEGKVGYELKDEIERKFDKWQEPPPVKQVKPLPAPLDGQRKKRGGRRYRKMKERLGLTEIRKQANRMSFGEIEEDAYQEDLGFSLGHLGKSGSGRVRQTQVNEATKARISKTLQRTLQKQSVVYGGKSTIRDRSSGTASSVAFTPLQGLEIVNPQAAEKKVAEANQKYFSSMAEFLKVKGEKSGLMST

SEQ ID NO: 468 - protein, 304 aa, Homo sapiens
MAEASAAGADSGAAVAAHRFFCHFCKGEVSPKLPEYICPRCESGFIEEVTDDSSFLGGGGSRIDNTTTTHFAELWGHLDHTMFFQDFRPFLSSSPLDQDNRANERGHQTHTDFWGARPPRLPLGRRYRSRGSSRPDRSPAIEGILQHIFAGFFANSAIPGSPHPFSWSGMLHSNPGDYAWGQTGLDAIVTQLLGQLENTGPPPADKEKITSLPTVTVTQEQVDMGLECPVCKEDYTVEEEVRQLPCNHFFHSSCIVPWLELHDTCPVCRKSLNGEDSTRQSQSTEASASNRFSNDSQLHDRWTF

SEQ ID NO: 469 - protein, 279 aa, Homo sapiens
MSLFDLFRGFFGFPGPRSHRDPFFGGMTRDEDDDEEEEEEGGSWGRGNPRFHSPQHPPEEFGFGFSFSPGGGIRFHDNFGFDDLVRDFNSIFSDMGAWTLPSHPPELPGPESETPGERLREGQTLRDSMLKYPDSHQPRIFGGVLESDARSESPQPAPDWGSQRPFHRFDDVWPMDPHPRTREDNDLDSQVSQEGLGPVLQPQPKSYFKSISVTKITKPDGIVEERRTVVDSEGRTETTVTRHEADSSPRGDPESPRPPALDDAFSILDLFLGRWFRSR

SEQ ID NO: 470 - protein, 150 aa, Homo sapiens
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 471 - protein, 474 aa, Homo sapiens
MNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANHHMQSISFASGGDPDTAEYVAYVAKDPVNQRACHILECPEGLAQDVISTIGQAFELRFKQYLRNPPKLVTPHDRMAGFDGSAWDEEEEEPPDHQYYNDFPGKEPPLGGVVDMRLREGAAPGAARPTAPNAQTPSHLGATLPVGQPVGGDPEVRKQMPPPPPCPAGRELFDDPSYVNVQNLDKARQAVGGAGPPNPAINGSAPRDLFDMKPFEDALRVPPPPQSVSMAEQLRGEPWFHGKLSRREAEALLQLNGDFLVRESTTTPGQYVLTGLQSGQPKHLLLVDPEGVVRTKDHRFESVSHLISYHMDNHLPIISAGSELCLQQPVERKL

SEQ ID NO: 472 - protein, 1297 aa, Homo sapiens
MIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLGSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 473 - protein, 1571 aa, Homo sapiens
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 474 - protein, 174 aa, Homo sapiens
MADVLDLHEAGGEDFAMDEDGDESIHKLKEKAKKRKGRGFGSEEGSRARMREDYDSVEQDGDEPGPQRSVEGWILFVTGVHEEATEEDIHDKFAEYGEIKNIHLNLDRRTGYLKGYTLVEYETYKEAQAAMEGLNGQDLMGQPISVDWCFVRGPPKGKRRGGRRRSRSPDRRRR

SEQ ID NO: 475 - protein, 534 aa, Homo sapiens
MTQAEIKLCSLLLQEHFGEIVEKIGVHLIRTGSQPLRVIAHDTGTSLDQVKKALCVLVQHNLVSYQVHKRGVVEYEAQCSRVLRMLRYPRYIYTTKTLYSDTGELIVEELLLNGKLTMSAVVKKVADRLTETMEDGKTMDYAEVSNTFVRLADTHFVQRCPSVPTTENSDPGPPPPAPTLVINEKDMYLVPKLSLIGKGKRRRSSDEDAAGEPKAKRPKYTTDNKEPIPDDGIYWQANLDRFHQHFRDQAIVSAVANRMDQTSSEIVRTMLRMSEITTSSSAPFTQPLSSNEIFRSLPVGYNISKQVLDQYLTLLADDPLEFVGKSGDSGGGMYVINLHKALASLATATLESVVQERFGSRCARIFRLVLQKKHIEQKQVEDFAMIPAKEAKDMLYKMLSENFMSLQEIPKTPDHAPSRTFYLYTVNILSAARMLLHRCYKSIANLIERRQFETKENKRLLEKSQRVEAIIASMQATGAEEAQLQEIEEMITAPERQQLETLKRNVNKLDASEIQVDETIFLLESYIECTMKRQ

SEQ ID NO: 476 - protein, 245 aa, Homo sapiens
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 477 - protein, 344 aa, Homo sapiens
MPRVYIGRLSYNVREKDIQRFFSGYGRLLEVDLKNGYGFVEFEDSRDADDAVYELNGKELCGERVIVEHARGPRRDRDGYSYGSRSGGGGYSSRRTSGRDKYGPPVRTEYRLIVENLSSRCSWQDLKDFMRQAGEVTYADAHKERTNEGVIEFRSYSDMKRALDKLDGTEINGRNIRLIEDKPRTSHRRSYSGSRSRSRSRRRSRSRSRRSSRSRSRSISKSRSRSRSRSKGRSRSRSKGRKSRSKSKSKPKSDRGSHSHSRSRSKDEYEKSRSRSRSRSPKENGKGDIKSKSRSRSQSRSNSPLPVPPSKARSVSPPPKRATSRSRSRSRSKSRSRSRSSSRD

SEQ ID NO: 478 - protein, 873 aa, Homo sapiens
MASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQMITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKRKFLNEQDLDELVNKSHMGYEQVREWFAERQRRSELGIELFEENEEEDEVIDDQEEDEEETDDSDTWEPPRHVKRKLSKSDD

SEQ ID NO: 479 - protein, 437 aa, Homo sapiens
MAEAEEDCHSDTVRADDDEENESPAETDLQAQLQMFRAQWMFELAPGVSSSNLENRPCRAARGSLQKTSADTKGKQEQAKEEKARELFLKAVEEEQNGALYEAIKFYRRAMQLVPDIEFKITYTRSPDGDGVGNSYIEDNDDDSKMADLLSYFQQQLTFQESVLKLCQPELESSQIHISVLPMEVLMYIFRWVVSSDLDLRSLEQLSLVCRGFYICARDPEIWRLACLKVWGRSCIKLVPYTSWREMFLERPRVRFDGVYISKTTYIRQGEQSLDGFYRAWHQVEYYRYIRFFPDGHVMMLTTPEEPQSIVPRLRTRNTRTDAILLGHYRLSQDTDNQTKVFAVITKKKEEKPLDYKYRYFRRVPVQEADQSFHVGLQLCSSGHQRFNKLIWIHHSCHITYKSTGETAVSAFEIDKMYTPLFFARVRSYTAFSERPL

SEQ ID NO: 480 - protein, 125 aa, Homo sapiens
MADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKTTTVKFNRRKVMDSDEDDDY

SEQ ID NO: 481 - protein, 576 aa, Homo sapiens
MQVPQDGEDLAGQPWYHGLLSRQKAEALLQQDGDFLVRASGSRGGNPVISCRWRGSALHFEVFRVALRPRPGRPTALFQLEDEQFPSIPALVHSYMTGRRPLSQATGAVVSRPVTWQGPLRRSFSEDTLMDGPARIEPLRARKWSNSQPADLAHMGRSREDPAGMEASTMPISALPRTSSDPVLLKAPAPLGTVADSLRASDGQLQAKAPTKPPRTPSFELPDASERPPTYCELVPRVPSVQGTSPSQSCPEPEAPWWEAEEDEEEENRCFTRPQAEISFCPHDAPSCLLGPQNRPLEPQVLHTLRGLFLEHHPGSTALHLLLVDCQATGLLGVTRDQRGNMGVSSGLELLTLPHGHHLRLELLERHQTLALAGALAVLGCSGPLEERAAALRGLVELALALRPGAAGDLPGLAAVMGALLMPQVSRLEHTWRQLRRSHTEAALAFEQELKPLMRALDEGAGPCDPGEVALPHVAPMVRLLEGEEVAGPLDESCERLLRTLHGARHMVRDAPKFRKVAAQRLRGFRPNPELREALTTGFVRRLLWGSRGAGAPRAERFEKFQRVLGVLSQRLEPDR

SEQ ID NO: 482 - protein, 184 aa, Homo sapiens
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 483 - protein, 449 aa, Homo sapiens
MLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 484 - protein, 799 aa, Homo sapiens
MPSQNYDLPQKKQEKMTKFQEAVTFKDVAVVFSREELRLLDLTQRKLYRDVMVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 485 - protein, 84 aa, Homo sapiens
MPLAKDLLHPSPEEEKRKHKKKRLVQSPNSYFMDVKCPGCYKITTVFSHAQTVVLCVGCSTVLCQPTGGKARLTEGCSFRRKQH

SEQ ID NO: 486 - protein, 634 aa, Homo sapiens
MVELLDLYQLEDEAYSSLAEATTELYQYLLQPFRDMRELAMLRRQQIKISMENDYLGPRRIESLQKEDADWQRKAHMAVLSIQDLTVKYFEITAKAQKAVYDRMRADQKKFGKASWAAAAERMEKLQYAVSKETLQMMRAKEICLEQRKHALKEEMQSLRGGTEAIARLDQLEADYYDLQLQLYEVQFEILKCEELLLTAQLESIKRLISEKRDEVVYYDTYESMEAMLEKEEMAASAYLQREELQKLQQKARQLEARRGRVSAKKSYLRNKKEICIAKHNEKIQQRTRIEDEYRTHHTVQLKREKLHDEEERKSAWVSQERQRTLDRLRTFKQRYPGQVILKSTRLRLAHARRKGAASPVLQEDHCDSLPSVLQVEEKTEEVGEGRVKRGPSQTTEPQSLVQLEDTSLTQLEATSLPLSGVTSELPPTISLPLLNNNLEPCSVTINPLPSPLPPTPPPPPPPPPPPPPPPLPVAKDSGPETLEKDLPRKEGNEKRIPKSASAPSAHLFDSSQLVSARKKLRKTAEGLQRRRVSSPMDEVLASLKRGSFHLKKVEQRTLPPFPDEDDSNNILAQIRKGVKLKKVQKDVLRESFTLLPDTDPLTRSIHEALRRIKEASPESEDEEEALPCTDWEN

SEQ ID NO: 487 - protein, 125 aa, Homo sapiens
MLRPKALTQVLSQANTGGVQSTLLLNNEGSLLAYSGYGDTDARVTAAIASNIWAAYDRNGNQAFNEDNLKFILMDCMEGRVAITRVANLLLCMYAKETVGFGMLKAKAQALVQYLEEPLTQVAAS

SEQ ID NO: 488 - protein, 95 aa, Homo sapiens
MEGGFGSDFGGSGSGKLDPGLIMEQVKVQIAVANAQELLQRMTDKCFRKCIGKPGGSLDNSEQKCIAMCMDRYMDAWNTVSRAYNSRLQRERANM

SEQ ID NO: 489 - protein, 544 aa, Homo sapiens
MGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGESQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 490 - protein, 338 aa, Homo sapiens
MDPETRGQEIIKVTPLQQMLASCTGAILTSVIVTPLDVVKIRLQAQNNPLPKGKCFVYSNGLMDHLCVCEEGGNKLWYKKPGNFQGTLDAFFKIIRNEGIKSLWSGLPPTLVMAVPATVIYFTCYDQLSALLRSKLGENETCIPIVAGIVARFGAVTVISPLELIRTKMQSKKFSYVELHRFVSKKVSEDGWISLWRGWAPTVLRDVPFSAMYWYNYEILKKWLCEKSGLYEPTFMINFTSGALSGSFAAVATLPFDVVKTQKQTQLWTYESHKISMPLHMSTWIIMKNIVAKNGFSGLFSGLIPRLIKIAPACAIMISTYEFGKAFFQKQNVRRQQY

SEQ ID NO: 491 - protein, 521 aa, Homo sapiens
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 492 - protein, 484 aa, Homo sapiens
MFPNSILGHPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPCFFQVNQKTEARHILTLVHKHFCTRLSGYIERPQLIRAKVPIVKFRDKVSCVEFDLNVNNIVGIRNTFLLRTYAYLENRVRPLVLVIKKWASHHQINDASRGTLSSYSLVLMVLHYLQTLPEPILPSLQKIYPESFSPAIQLHLVHQAPCNVPPYLSKNESNLGDLLLGFLKYYATEFDWNSQMISVREAKAIPRPDGIEWRNKYICVEEPFDGTNTARAVHEKQKFDMIKDQFLKSWHRLKNKRDLNSILPVRAAVLKR

SEQ ID NO: 493 - protein, 674 aa, Homo sapiens
MNSGAMRIHSKGHFQGGIQVKNEKNRPSLKSLKTDNRPEKSKCKPLWGKVFYLDLPSVTISEKLQKDIKDLGGRVEEFLSKDISYLISNKKEAKFAQTLGRISPVPSPESAYTAETTSPHPSHDGSSFKSPDTVCLSRGKLLVEKAIKDHDFIPSNSILSNALSWGVKILHIDDIRYYIEQKKKELYLLKKSSTSVRDGGKRVGSGAQKTRTGRLKKPFVKVEDMSQLYRPFYLQLTNMPFINYSIQKPCSPFDVDKPSSMQKQTQVKLRIQTDGDKYGGTSIQLQLKEKKKKGYCECCLQKYEDLETHLLSEQHRNFAQSNQYQVVDDIVSKLVFDFVEYEKDTPKKKRIKYSVGSLSPVSASVLKKTEQKEKVELQHISQKDCQEDDTTVKEQNFLYKETQETEKKLLFISEPIPHPSNELRGLNEKMSNKCSMLSTAEDDIRQNFTQLPLHKNKQECILDISEHTLSENDLEELRVDHYKCNIQASVHVSDFSTDNSGSQPKQKSDTVLFPAKDLKEKDLHSIFTHDSGLITINSSQEHLTVQAKAPFHTPPEEPNECDFKNMDSLPSGKIHRKVKIILGRNRKENLEPNAEFDKRTEFITQEENRICSSPVQSLLDLFQTSEEKSEFLGFTSYTEKSGICNVLDIWEEENSDNLLTAFFSSPSTSTFTGF

SEQ ID NO: 494 - protein, 90 aa, Homo sapiens
MMLGSLAPDPGSRRHSGQAALRPRRYPTLWDRCRKRWLRPIFTQLLAAGLAYHTLLPIPSEPLFAAPGEHLHQCFVKESYCPPRVLAKEQ

SEQ ID NO: 495 - protein, 1555 aa, Homo sapiens
MSEQTPAEAGAAGAREDACRDYQSSLEDLTFNSKPHINMLTILAEENLPFAKEIVSLIEAQTAKAPSSEKLPVMYLMDSIVKNVGREYLTAFTKNLVATFICVFEKVDENTRKSLFKLRSTWDEIFPLKKLYALDVRVNSLDPAWPIKPLPPNVNTSSIHVNPKFLNKSPEEPSTPGTVVSSPSISTPPIVPDIQKNLTQEQLIRQQLLAKQKQLLELQQKKLELELEQAKAQLAVSLSVQQETSNLGPGSAPSKLHVSQIPPMAVKAPHQVPVQSEKSRPGPSLQIQDLKGTNRDPRLNRISQHSHGKDQSHRKEFLMNTLNQSDTKTSKTIPSEKLNSSKQEKSKSGEKITKKELDQLDSKSKSKSKSPSPLKNKLSHTKDLKNQESESMRLSDMNKRDPRLKKHLQDKTDGKDDDVKEKRKTAEKKDKDEHMKSSEHRLAGSRNKIINGIVQKQDTITEESEKQGTKPGRSSTRKRSRSRSPKSRSPIIHSPKRRDRRSPKRRQRSMSPTSTPKAGKIRQSGAKQSHMEEFTPPSREDRNAKRSTKQDIRDPRRMKKTEEERPQETTNQHSTKSGTEPKENVENWQSSKSAKRWKSGWEENKSLQQVDEHSKPPHLRHRESWSSTKGILSPRAPKQQQHRLSVDANLQIPKELTLASKRELLQKTSERLASGEITQDDFLVVVHQIRQLFQYQEGVREEQRSPFNDRFPLKRPRYEDSDKPFVDSPASRFAGLDTNQRLTALAEDRPLFDGPSRPSVARDGPTKMIFEGPNKLSPRIDGPPTPASLRFDGSPGQMGGGGPLRFEGPQGQLGGGCPLRFEGPPGPVGTPLRFEGPIGQAGGGGFRFEGSPGLRFEGSPGGLRFEGPGGQPVGGLRFEGHRGQPVGGLRFEGPHGQPVGGLRFDNPRGQPVGGLRFEGGHGPSGAAIRFDGPHGQPGGGIRFEGPLLQQGVGMRFEGPHGQSVAGLRFEGQHNQLGGNLRFEGPHGQPGVGIRFEGPLVQQGGGMRFEGPSVPGGGLRIEGPLGQGGPRFEGCHALRFDGQPGQPSLLPRFDGLHGQPGPRFERTPGQPGPQRFDGPPGQQVQPRFDGVPQRFDGPQHQQASRFDIPLGLQGTRFDNHPSQRLESVSFNQTGPYNDPPGNAFNAPSQGLQFQRHEQIFDSPQGPNFNGPHGPGNQSFSNPLNRASGHYFDEKNLQSSQFGNFGNIPAPMTVGNIQASQQVLSGVAQPVAFGQGQQFLPVHPQNPGFVQNPSGALPKAYPDNHLSQVDVNELFSKLLKTGILKLSQTDSATTQVSEVTAQPPPEEEEDQNEDQDVPDLTNFTVEELKQRYDSVINRLYTGIQCYSCGMRFTTSQTDVYADHLDWHYRQNRTEKDVSRKVTHRRWYYSLTDWIEFEEIADLEERAKSQFFEKVHEEVVLKTQEAAKEKEFQSVPAGPAGAVESCEICQEQFEQYWDEEEEEWHLKNAIRVDGKIYHPSCYEDYQNTSSFDCTPSPSKTPVENPLNIMLNIVKNELQEPCDSPKVKEERIDTPPACTEESIATPSEIKTENDTVESV

SEQ ID NO: 496 - protein, 180 aa, Homo sapiens
MGLTVSALFSRIFGKKQMRILMVGLDAAGKTTILYKLKLGEIVTTIPTIGFNVETVEYKNICFTVWDVGGQDKIRPLWRHYFQNTQGLIFVVDSNDRERVQESADELQKMLQEDELRDAVLLVFANKQDMPNAMPVSELTDKLGLQHLRSRTWYVQATCATQGTGLYDGLDWLSHELSKR

SEQ ID NO: 497 - protein, 378 aa, Homo sapiens
MVDYSVWDHIEVSDDEDETHPNIDTASLFRWRHQARVERMEQFQKEKEELDRGCRECKRKVAECQRKLKELEVAEGGKAELERLQAEAQQLRKEERSWEQKLEEMRKKEKSMPWNVDTLSKDGFSKSMVNTKPEKTEEDSEEVREQKHKTFVEKYEKQIKHFGMLRRWDDSQKYLSDNVHLVCEETANYLVIWCIDLEVEEKCALMEQVAHQTIVMQFILELAKSLKVDPRACFRQFFTKIKTADRQYMEGFNDELEAFKERVRGRAKLRIEKAMKEYEEEERKKRLGPGGLDPVEVYESLPEELQKCFDVKDVQMLQDAISKMDPTDAKYHMQRCIDSGLWVPNSKASEAKEGEEAGPGDPLLEAVPKTGDEKDVSV

SEQ ID NO: 498 - protein, 247 aa, Homo sapiens
MADTTPSGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRTLFNELRIVVEHIIMKPACPLFVRRLCLQSIAFISRLAPTVP

SEQ ID NO: 499 - protein, 326 aa, Homo sapiens
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 500 - protein, 56 aa, Homo sapiens
MVTRFLGPRYRELVKNWVPTAYTWGAVGAVGLVWATDWRLILDWVPYINGKFKKDN

SEQ ID NO: 501 - protein, 664 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMYILRMANETDSFFISWDDFWDLICNLIISGCDSTLTVLGMSAVISSVAHYLGLGILAFIGSTEEDDRRLGFVAPVLFFILALQTGLSGLRPEERLIRLSRNMCLLLTAVLHFIHGMTDPVLMSLSASHVSSFRRHFPVLFVSACLFILPVLLSYVLWHHYALNTWLFAVTAFCVELCLKVIVSLTVYTLFMIDGYYNVLWEKLDDYVYYVRSTGSIIEFIFGVVMFGNGAYTMMFESGSKIRAFMMCLHAYFNIYLQAKNGWKTFMNRRTAVKKINSLPEIKGSRLQEINDVCAICYHEFTTSARITPCNHYFHALCLRKWLYIQDTCPMCHQKVYIEDDIKDNSNVSNNNGFIPPNETPEEAVREAAAESDRELNEDDSTDCDDDVQRERNGVIQHTGAAAEEFNDDTD

SEQ ID NO: 502 - protein, 360 aa, Homo sapiens
MPKFKQRRRKLKAKAERLFKKKEASHFQSKLITPPPPPPSPERVGISSIDISQSRSWLTSSWNFNFPNIRDAIKLWTNRVWSIYSWCQNCITQSLEVLKDTIFPSRICHRELYSVKQQFCILESKLCKLQEALKTISESSSCPSCGQTCHMSGKLTNVPACVLITPGDSKAVLPPTLPQPASHFPPPPPPPPLPPPPPPLAPVLLRKPSLAKALQAGPLKKDGPMQITVKDLLTVKLKKTQSLDEKRKLIPSPKARNPLVTVSDLQHVTLKPNSKVLSTRVTNVLITPGKSQMDLRKLLRKVDVERRPGGTPLTNKENMETGTGLTPVMTQALRRKFQLAHPRSPTPTLPLSTSSFDEQN

SEQ ID NO: 503 - protein, 260 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 504 - protein, 403 aa, Homo sapiens
MAGAATQASLESAPRIMRLVAECSRSRARAGELWLPHGTVATPVFMPVGTQATMKGITTEQLDALGCRICLGNTYHLGLRPGPELIQKANGLHGFMNWPHNLLTDSGGFQMVSLVSLSEVTEEGVRFRSPYDGNETLLSPEKSVQIQNALGSDIIMQLDDVVSSTVTGPRVEEAMYRSIRWLDRCIAAHQRPDKQNLFAIIQGGLDADLRATCLEEMTKRDVPGFAIGGLSGGESKSQFWRMVALSTSRLPKDKPRYLMGVGYATDLVVCVALGCDMFDCVFPTRTARFGSALVPTGNLQLRKKVFEKDFGPIDPECTCPTCQKHSRAFLHALLHSDNTAALHHLTVHNIAYQLQLMSAVRTSIVEKRFPDFVRDFMGAMYGDPTLCPTWATDALASVGITLG

SEQ ID NO: 505 - protein, 580 aa, Homo sapiens
MFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 506 - protein, 217 aa, Homo sapiens
MSNPFLKQVFNKDKTFRPKRKFEPGTQRFELHKKAQASLNAGLDLRLAVQLPPGEDLNDWVAVHVVDFFNRVNLIYGTISDGCTEQSCPVMSGGPKYEYRWQDEHKFRKPTALSAPRYMDLLMDWIEAQINNEDLFPTNVGTPFPKNFLQTVRKILSRLFRVFVHVYIHHFDRIAQMGSEAHVNTCYKHFYYFVKEFGLIDTKELEPLKEMTARMCH

SEQ ID NO: 507 - protein, 211 aa, Homo sapiens [sequence omitted]

SEQ ID NO: 508 - protein, 146 aa, Homo sapiens
MLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 509 - protein, 297 aa, Homo sapiens
MSRFKFIDIGINLTDPMFRGIYRGVQKHQDDLQDVIGRAVEIGVKKFMITGGNLQDSKDALHLAQTNGMFFSTVGCHPTRCGEFEKNNPDLYLKELLNLAENNKGKVVAIGECGLDFDRLQFCPKDTQLKYFEKQFELSEQTKLPMFLHCRNSHAEFLDIMKRNRDRCVGGVVHSFDGTKEAAAALIDLDLYIGFNGCSLKTEANLEVLKSIPSEKLMIETDAPWCGVKSTHAGSKYIRTAFPTKKKWESGHCLKDRNEPCHIIQILEIMSAVRDEDPLELANTLYNNTIKVFFPGI

SEQ ID NO: 510 - protein, 320 aa, Homo sapiens
MPTGDFDSKPSWADQVEEEGEDDKCVTSELLKGIPLATGDTSPEPELLPGAPLPPPKEVINGNIKTVTEYKIDEDGKKFKIVRTFRIETRKASKAVARRKNWKKFGNSEFDPPGPNVATTTVSDDVSMTFITSKEDLNCQEEEDPMNKLKGQKIVSCRICKGDHWTTRCPYKDTLGPMQKELAEQLGLSTGEKEKLPGELEPVQATQNKTGKYVPPSLRDGASRRGESMQPNRRADDNATIRVTNLSEDTRETDLQELFRPFGSISRIYLAKDKTTGQSKGFAFISFHRREDRARAIAGVSGFGYDHLILNVEWAKPSTN

SEQ ID NO: 511 - protein, 297 aa, Homo sapiens
MRALRAGLTLASGAGLGAVVEGWRRRREDARAALGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSKVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 512 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 513 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 514 - protein, 361 aa, Homo sapiens [sequence omitted]

SEQ ID NO: 515 - protein, 1050 aa, Homo sapiens
MALYDEDLLKNPFYLALQKCRPDLCSKVAQIHGIVLVPCKGSLSSSIQSTCQFESYILIPVEEHFQTLNGKDVFIQGNRIKLGAGFACLLSVPILFEETFYNEKEESFSILCIAHPLEKRESSEEPLAPSDPFSLKTIEDVREFLGRHSERFDRNIASFHRTFRECERKSLRHHIDSANALYTKCLQQLLRDSHLKMLAKQEAQMNLMKQAVEIYVHHEIYNLIFKYVGTMEASEDAAFNKITRSLQDLQQKDIGVKPEFSFNIPRAKRELAQLNKCTSPQQKLVCLRKVVQLITQSPSQRVNLETMCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPLCFCDDCEKLVSGRLNDPSVVTPFSRDDRGHTPLHVAAVCGQASLIDLLVSKGAMVNATDYHGATPLHLACQKGYQSVTLLLLHYKASAEVQDNNGNTPLHLACTYGHEDCVKALVYYDVESCRLDIGNEKGDTPLHIAARWGYQGVIETLLQNGASTEIQNRLKETPLKCALNSKILSVMEAYHLSFERRQKSSEAPVQSPQRSVDSISQESSTSSFSSMSAGSRQEETKKDYREVEKLLRAVADGDLEMVRYLLEWTEEDLEDAEDTVSAADPEFCHPLCQCPKCAPAQKRLAKVPASGLGVNVTSQDGSSPLHVAALHGRADLIRLLLKHGANAGARNADQAVPLHLACQQGHFQVVKCLLDSNAKPNKKDLSGNTPLIYACSGGHHELVALLLQHGASINASNNKGNTALHEAVIEKHVFVVELLLLHGASVQVLNKRQRTAVDCAEQNSKIMELLQVVPSCVASLDDVAETDRKEYVTVKIRKKWNSKLYDLPDEPFTRQFYFVHSAGQFKGKTSREIMARDRSVPNLTEGSLHEPGRQSVTLRQNNLPAQSGSHAAEKGNSDWPERPGLTQTGPGHRRMLRRHTVEDAVVSQGPEAAGPLSTPQEVSASRS

SEQ ID NO: 516 - protein, 362 aa, Homo sapiens
MSDEGSRGSRLPLALPPASQGCSSGGGGGGGGGSSAGGSGNSRPPRNLQGLLQMAITAGSEEPDPPPEPMSEERRQWLQEAMSAAFRGQREEVEQMKSCLRVLSQPMPPTAGEAEQAADQQEREGALELLADLCENMDNAADFCQLSGMHLLVGRYLEAGAAGLRWRAAQLIGTCSQNVAAIQEQVLGLGALRKLLRLLDRDACDTVRVKALFAISCLVREQEAGLLQFLRLDGFSVLMRAMQQQVQKLKVKSAFLLQNLLVGHPEHKGTLCSMGMVQQLVALVRTEHSPFHEHVLGALCSLVTDFPQGVRECREPELGLEELLRHRCQLLQQHEEYQEELEFCEKLLQTCFSSPADDSMDR

SEQ ID NO: 517 - protein, 764 aa, Homo sapiens
MSDTRRRVKVYTLNEDRQWDDRGTGHVSSTYVEELKGMSLLVRAESDGSLLLESKINPNTAYQKQQDTLIVWSEAENYDLALSFQEKAGCDEIWEKICQVQGKDPSVEVTQDLIDESEEERFEEMPETSHLIDLPTCELNKLEEIADLVTSVLSSPIRREKLALALENEGYIKKLLQLFQACENLENTEGLHHLYEIIRGILFLNKATLFEVMFSDECIMDVVGCLEYDPALAQPKRHREFLTKTAKFKEVIPITDSELRQKIHQTYRVQYIQDIILPTPSVFEENFLSTLTSFIFFNKVEIVSMLQEDEKFLSEVFAQLTDEATDDDKRRELVNFFKEFCAFSQTLQPQNRDAFFKTLAKLGILPALEIVMGMDDLQVRSAATDIFSYLVEFSPSMVREFVMQEAQQSDDDILLINVVIEQMICDTDPELGGAVQLMGLLRTLIDPENMLATTNKTEKSEFLNFFYNHCMHVLTAPLLTNTSEDKCEKDNIVGSNKNNTICPGALRFMRRIIGLKDEFYNRYITKGNLFEPVINALLDNGTRYNLLNSAVIELFEFIRVEDIKSLTAHIVENFYKALESIEYVQTFKGLKTKYEQEKDRQNQKLNSVPSILRSNRFRRDAKALEEDEEMWFNEDEEEEGKAVVAPVEKPKPEDDFPDNYEKFMETKKAKESEDKENLPKRTSPGGFKFTFSHSASAANGTNSKSVVAQIPPATSNGSSSKTTNLPTSVTATKGSLVGLVDYPDDEEEDEEEESSPRKRPRLGS

SEQ ID NO: 518 - protein, 728 aa, Homo sapiens
MWVTKLLPALLLQHVLLHLLLLPIAIPYAEGQRKRRNTIHEFKKSAKTTLIKIDPALKIKTKKVNTADQCANRCTRNKGLPFTCKAFVFDKARKQCLWFPFNSMSSGVKKEFGHEFDLYENKDYIRNCIIGKGRSYKGTVSITKSGIKCQPWSSMIPHEHSFLPSSYRGKDLQENYCRNPRGEEGGPWCFTSNPEVRYEVCDIPQCSEVECMTCNGESYRGLMDHTESGKICQRWDHQTPHRHKFLPERYPDKGFDDNYCRNPDGQPRPWCYTLDPHTRWEYCAIKTCADNTMNDTDVPLETTECIQGQGEGYRGTVNTIWNGIPCQRWDSQYPHEHDMTPENFKCKDLRENYCRNPDGSESPWCFTTDPNIRVGYCSQIPNCDMSHGQDCYRGNGKNYMGNLSQTRSGLTCSMWDKNMEDLHRHIFWEPDASKLNENYCRNPDDDAHGPWCYTGNPLIPWDYCPISRCEGDTTPTIVNLDHPVISCAKTKQLRVVNGIPTRTNIGWMVSLRYRNKHICGGSLIKESWVLTARQCFPSRDLKDYEAWLGIHDVHGRGDEKCKQVLNVSQLVYGPEGSDLVLMKLARPAVLDDFVSTIDLPNYGCTIPEKTSCSVYGWGYTGLINYDGLLRVAHLYIMGNEKCSQHHRGKVTLNESEICAGAEKIGSGPCEGDYGGPLVCEQHKMRMVLGVIVPGRGCAIPNRPGIFVRVAYYAKWIHKIILTYKVPQS

SEQ ID NO: 519 - protein, 1749 aa, Homo sapiens
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 520 - protein, 888 aa, Homo sapiens [sequence omitted]

SEQ ID NO: 521 - protein, 898 aa, Homo sapiens
MFSQQQQQQLQQQQQQLQQLQQQQLQQQQLQQQQLLQLQQLLQQSPPQAPLPMAVSRGLPPQQPQQPLLNLQGTNSASLLNGSMLQRALLLQQLQGLDQFAMPPATYDTAGLTMPTATLGNLRGYGMASPGLAAPSLTPPQLATPNLQQFFPQATRQSLLGPPPVGVPMNPSQFNLSGRNPQKQARTSSSTTPNRKDSSSQTMPVEDKSDPPEGSEEAAEPRMDTPEDQDLPPCPEDIAKEKRTPAPEPEPCEASELPAKRLRSSEEPTEKEPPGQLQVKAQPQARMTVPKQTQTPDLLPEALEAQVLPRFQPRVLQVQAQVQSQTQPRIPSTDTQVQPKLQKQAQTQTSPEHLVLQQKQVQPQLQQEAEPQKQVQPQVQPQAHSQGPRQVQLQQEAEPLKQVQPQVQPQAHSQPPRQVQLQLQKQVQTQTYPQVHTQAQPSVQPQEHPPAQVSVQPPEQTHEQPHTQPQVSLLAPEQTPVVVHVCGLEMPPDAVEAGGGMEKTLPEPVGTQVSMEEIQNESACGLDVGECENRAREMPGVWGAGGSLKVTILQSSDSRAFSTVPLTPVPRPSDSVSSTPAATSTPSKQALQFFCYICKASCSSQQEFQDHMSEPQHQQRLGEIQHMSQACLLSLLPVPRDVLETEDEEPPPRRWCNTCQLYYMGDLIQHRRTQDHKIAKQSLRPFCTVCNRYFKTPRKFVEHVKSQGHKDKAKELKSLEKEIAGQDEDHFITVDAVGCFEGDEEEEEDDEDEEEIEVEEELCKQVRSRDISREEWKGSETYSPNTAYGVDFLVPVMGYICRICHKFYHSNSGAQLSHCKSLGHFENLQKYKAAKNPSPTTRPVSRRCAINARNALTALFTSSGRPPSQPNTQDKTPSKVTARPSQPPLPRRSTRLKT

SEQ ID NO: 522 - protein, 251 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSSCVRTDYLD

SEQ ID NO: 523 - protein, 492 aa, Homo sapiens
MGSAPWAPVLLLALGLRGLQAGARRAPDPGFQERFFQQRLDHFNFERFGNKTFPQRFLVSDRFWVRGEGPTFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 524 - protein, 923 aa, Homo sapiens
MEGAKPTLQLVYQAVQALYHDPDPSGKERASFWLGELQRSVHAWEISDQLLQIRQDVESCYFAAQTMKMKIQTSFYELPTDSHASLRDSLLTHIQNLKDLSPVIVTQLALAIADLALQMPSWKGCVQTLVEKYSNDVTSLPFLLEILTVLPEEVHSRSLRIGANRRTEIIEDLAFYSSTVVSLLMTCVEKAGTDEKMLMKVFRCLGSWFNLGVLDSNFMANNKLLALLFEVLQQDKTSSNLHEAASDCVCSALYAIENVETNLPLAMQLFQGVLTLETAYHMAVAREDLDKVLNYCRIFTELCETFLEKIVCTPGQGLGDLRTLELLLICAGHPQYEVVEISFNFWYRLGEHLYKTNDEVIHGIFKAYIQRLLHALARHCQLEPDHEGVPEETDDFGEFRMRVSDLVKDLIFLIGSMECFAQLYSTLKEGNPPWEVTEAVLFIMAAIAKSVDPENNPTLVEVLEGVVRLPETVHTAVRYTSIELVGEMSEVVDRNPQFLDPVLGYLMKGLCEKPLASAAAKAIHNICSVCRDHMAQHFNGLLEIARSLDSFLLSPEAAVGLLKGTALVLARLPLDKITECLSELCSVQVMALKKLLSQEPSNGISSDPTVFLDRLAVIFRHTNPIVENGQTHPCQKVIQEIWPVLSETLNKHRADNRIVERCCRCLRFAVRCVGKGSAALLQPLVTQMVNVYHVHQHSCFLYLGSILVDEYGMEEGCRQGLLDMLQALCIPTFQLLEQQNGLQNHPDTVDDLFRLATRFIQRSPVTLLRSQVVIPILQWAIASTTLDHRDANCSVMRFLRDLIHTGVANDHEEDFELRKELIGQVMNQLGQQLVSQLLHTCCFCLPPYTLPDVAEVLWEIMQVDRPTFCRWLENSLKGLPKETTVGAVTVTHKQLTDFHKQVTSAEECKQVCWALRDFTRLFR

SEQ ID NO: 525 - protein, 364 aa, Homo sapiens
MQKWFSAFDDAIIQRQWRANPSRGGGGVSFTKEVDTNVATGAPPRRQRVPGRACPWREPIRGRRGARPGGGDAGGTPGETVRHCSAPEDPIFRFSSLHSYPFPGTIKSRDMSWKRHHLIPETFGVKRRRKRGPVESDPLRGEPGSARAAVSELMQLFPRGLFEDALPPIVLRSQVYSLVPDRTVADRQLKELQEQGEIRIVQLGFDLDAHGIIFTEDYRTRVLKACDGRPYAGAVQKFLASVLPACGDLSFQQDQMTQTFGFRDSEITHLVNAGVLTVRDAGSWWLAVPGAGRFIKYFVKGRQAVLSMVRKAKYRELLLSELLGRRAPVVVRLGLTYHVHDLIGAQLVDCISTTSGTLLRLPET

SEQ ID NO: 526 - protein, 178 aa, Homo sapiens
MSSFSRAPQQWATFARIWYLLDGKMQPPGKLAAMASIRLQGLHKPVYHALSDCGDHVVIMNTRHIAFSGNKWEQKVYSSHTGYPGGFRQVTAAQLHLRDPVAIVKLAIYGMLPKNLHRRTMMERLHLFPDEYIPEDILKNLVEELPQPRKIPKRLDEYTQEEIDAFPRLWTPPEDYRL

SEQ ID NO: 527 - protein, 1441 aa, Homo sapiens
MATAAAAAAVMAPPGCPGSCPNFAVVCSFLERYGPLLDLPELPFPELERVLQAPPPDVGNGEVPKELVELHLKLMRKIGKSVTADRWEKYLIKICQEFNSTWAWEMEKKGYLEMSVECKLALLKYLCECQFDDNLKFKNIINEEDADTMRLQPIGRDKDGLMYWYQLDQDHNVRMYIEEQDDQDGSSWKCIVRNRNELAETLALLKAQIDPVLLKNSSQQDNSSRESPSLEDEETKKEEETPKQEEQKESEKMKSEEQPMDLENRSTANVLEETTVKKEKEDEKELVKLPVIVKLEKPLPENEEKKIIKEESDSFKENVKPIKVEVKECRADPKDTKSSMEKPVAQEPERIEFGGNIKSSHEITEKSTEETEKLKNDQQAKIPLKKREIKLSDDFDSPVKGPLCKSVTPTKEFLKDEIKQEEETCKRISTITALGHEGKQLVNGEVSDERVAPNFKTEPIETKFYETKEESYSPSKDRNIITEGNGTESLNSVITSMKTGELEKETAPLRKDADSSISVLEIHSQKAQIEEPDPPEMETSLDSSEMAKDLSSKTALSSTESCTMKGEEKSPKTKKDKRPPILECLEKLEKSKKTFLDKDAQRLSPIPEEVPKSTLESEKPGSPEAAETSPPSNIIDHCEKLASEKEVVECQSTSTVGGQSVKKVDLETLKEDSEFTKVEMDNLDNAQTSGIEEPSETKGSMQKSKFKYKLVPEEETTASENTEITSERQKEGIKLTIRISSRKKKPDSPPKVLEPENKQEKTEKEEEKTNVGRTLRRSPRISRPTAKVAEIRDQKADKKRGEGEDEVEEESTALQKTDKKEILKKSEKDTNSKVSKVKPKGKVRWTGSRTRGRWKYSSNDESEGSGSEKSSAASEEEEEKESEEAILADDDEPCKKCGLPNHPELILLCDSCDSGYHTACLRPPLMIIPDGEWFCPPCQHKLLCEKLEEQLQDLDVALKKKERAERRKERLVYVGISIENIIPPQEPDFSEDQEEKKKDSKKSKANLLERRSTRTRKCISYRFDEFDEAIDEAIEDDIKEADGGGVGRGKDISTITGHRGKDISTILDEERKENKRPQRAAAARRKKRRRLNDLDSDSNLDEEESEDEFKISDGSQDEFVVSDENPDESEEDPPSNDDSDTDFCSRRLRRHPSRPMRQSRRLRRKTPKKKYSDDDEEEESEENSRDSESDFSDDFSDDFVETRRRRSRRNQKRQINYKEDSESDGSQKSLRRGKEIRRVHKRRLSSSESEESYLSKNSEDDELAKESKRSVRKRGRSTDEYSEADEEEEEEEGKPSRKRLHRIETDEEESCDNAHGDANQPARDSQPRVLPSEQESTKKPYRIESDEEEDFENVGKVGSPLDYSLVDLPSTNGQSPGKAIENLIGKPTEKSQTPKDNSTASASLASNGTSGGQEAGAPEEEEDELLRVTDLVDYVCNSEQL

SEQ ID NO: 528 - protein, 400 aa, Homo sapiens [sequence omitted]

SEQ ID NO: 529 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 530 - protein, 702 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLCEKSIGTANRPMGAGEALRRVLECLASGIVMPDGSGIYDPCEKEATDAIGHLDRQQREDITQSAQHALRLAAFGQLHKVLGMDPLPSKMPKKPKNENPVDYTVQIPPSTTYAITPMKRPMEEDGEEKSPSKKKKKIQKKEEKAEPPQAMNALMRLNQLKPGLQYKLVSQTGPVHAPIFTMSVEVDGNSFEASGPSKKTAKLHVAVKVLQDMGLPTGAEGRDSSKGEDSAEETEAKPAVVAPAPVVEAVSTPSAAFPSDATAEQGPILTKHGKNPVMELNEKRRGLKYELISETGGSHDKRFVMEVEVDGQKFQGAGSNKKVAKAYAALAALEKLFPDTPLALDANKKKRAPVPVRGGPKFAAKPHNPGFGMGGPMHNEVPPPPNLRGRGRGGSIRGRGRGRGFGGANHGGYMNAGAGYGSYGYGGNSATAGYSDFFTDCYGYHDFGSS

SEQ ID NO: 531 - protein, 870 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 532 - protein, 1267 aa, Homo sapiens
MAADEGSAEKQAGEAHMAADGETNGSCENSDASSHANAAKHTQDSARVNPQDGTNTLTRIAENGVSERDSEAAKQNHVTADDFVQTSVIGSNGYILNKPALQAQPLRTTSTLASSLPGHAAKTLPGGAGKGRTPSAFPQTPAAPPATLGEGSADTEDRKLPAPGADVKVHRARKTMPKSVVGLHAASKDPREVREARDHKEPKEEINKNISDFGRQQLLPPFPSLHQSLPQNQCYMATTKSQTACLPFVLAAAVSRKKKRRMGTYSLVPKKKTKVLKQRTVIEMFKSITHSTVGSKGEKDLGASSLHVNGESLEMDSDEDDSEELEEDDGHGAEQAAAFPTEDSRTSKESMSEADRAQKMDGESEEEQESVDTGEEEEGGDESDLSSESSIKKKFLKRKGKTDSPWIKPARKRRRRSRKKPSGALGSESYKSSAGSAEQTAPGDSTGYMEVSLDSLDLRVKGILSSQAEGLANGPDVLETDGLQEVPLCSCRMETPKSREITTLANNQCMATESVDHELGRCTNSVVKYELMRPSNKAPLLVLCEDHRGRMVKHQCCPGCGYFCTAGNFMECQPESSISHRFHKDCASRVNNASYCPHCGEESSKAKEVTIAKADTTSTVTPVPGQEKGSALEGRADTTTGSAAGPPLSEDDKLQGAASHVPEGFDPTGPAGLGRPTPGLSQGPGKETLESALIALDSEKPKKLRFHPKQLYFSARQGELQKVLLMLVDGIDPNFKMEHQNKRSPLHAAAEAGHVDICHMLVQAGANIDTCSEDQRTPLMEAAENNHLEAVKYLIKAGALVDPKDAEGSTCLHLAAKKGHYEVVQYLLSNGQMDVNCQDDGGWTPMIWATEYKHVDLVKLLLSKGSDINIRDNEENICLHWAAFSGCVDIAEILLAAKCDLHAVNIHGDSPLHIAARENRYDCVVLFLSRDSDVTLKNKEGETPLQCASLNSQVWSALQMSKALQDSAPDRPSPVERIVSRDIARGYERIPIPCVNAVDSEPCPSNYKYVSQNCVTSPMNIDRNITHLQYCVCIDDCSSSNCMCGQLSMRCWYDKDGRLLPEFNMAEPPLIFECNHACSCWRNCRNRVVQNGLRARLQLYRTRDMGWGVRSLQDIPPGTFVCEYVGELISDSEADVREEDSYLFDLDNKDGEVYCIDARFYGNVSRFINHHCEPNLVPVRVFMAHQDLRFPRIAFFSTRLIEAGEQLGFDYGERFWDIKGKLFSCRCGSPKCRHSSAALAQRQASAAQEAQEDGLPDTSSAAAADPL

SEQ ID NO: 533 - protein, 165 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 534 - protein, 246 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 535 - protein, 84 aa, Homo sapiens
MAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 536 - protein, 475 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVPDSAHKLFIGGLPNYLNDDQVKELLTSFGPLKAFNLVKDSATGLSKGYAFCEYVDINVTDQAIAGLNGMQLGDKKLLVQRASVGAKNATLVSPPSTINQTPVTLQVPGLMSSQVQMGGHPTEVLCLMNMVLPEELLDDEEYEEIVEDVRDECSKYGLVKSIEIPRPVDGVEVPGCGKIFVEFTSVFDCQKAMQGLTGRKFANRVVVTKYCDPDSYHRRDFW

SEQ ID NO: 537 - protein, 1221 aa, Homo sapiens
MLRSTGFFRAIDCPYWSGAPGGPCRRPYCHFRHRGARGPGAPGDGGEAPPAAGLGYDPYNPELPKPPAQRENGTLGLGEEPRPDVLELELVNQAIEAVRSEVELEQRRYRELLETTREHRSAEAPALAPRGPNASPTVGPDEDAFPLAFDYSPGSHGLLSPDAGYQPTPLAAPAEPGSKYSLASLDRGQGRGGGGGGALEYVPKAVSQPRRHSRPVPSGKYVVDNSRPPTDLEYDPLSNYSARHLSRASSRDERAAKRPRGSRGSEPYTPAPKKLCDPFGSCDARFSDSEDEAATVPGNEPTTASTPKARADPEIKATGQPPSKEGLEAEGGGLRETKETAVQCDVGDLQPPPAKPASPAQVQSSQDGGCPKEGKPKKKKTGAPPAPSCKDGAQGKDKTKDKGRGRPVEKPRADKKGPQASSPRRKAERPEGTKKKPSSATPVATSGKGRPDRPARRPSPTSGDSRPAAGRGPPRPLQLPDRKSTKAPSGKLVERKARSLDEGASQDAPKLKKRALSHADLFGDESEDEAAGPGVPSVWPSALPSLSSDSDSDSDSSLGFPEAQGPPKRLKASPPPSPAPSSSSSSSSSTSSAGADVDYSALEKEVDFDSDPMEECLRIFNESTSVKTEDRGRLARQPPKEEKSEEKGLSGLTTLFPGQKRRISHLSKQGQEVEPPRRGPAVPPARPPTAQEVCYLRAQQAQRASASLLQAPARLAEKSPSVHISAPGEKRRIAHIPNPRLAAAPTGAKRTLAASGSQPSNGPEPGGQQLKTRTLSGMASKTTTTIIPKRIAHSPSLQSLKKPIIPKEFGGKVPTVIRQRYLNLFIEECLKFCTSNQEAIEKALNEEKVAYDRSPSKNIYLNVAVNTLKKLRGLAPSAVPGLSKTSGRRVVSHEVVLGGRLAAKTSFSLSRPSSPRVEDLKGAALYSRLREYLLTQDQLKENGYPFPHPERPGGAIIFTAEEKRPKDSSCRTCCRCGTEYLVSSSGRCIRDEECYYHWGRLRRNRVAGGWETQYMCCSAAAGSVGCQVAKQHVQDGRKERLEGFVKTFEKELSGDTHPGIYALDCEMSYTTYGLELTRVTVVDTDVHVVYDTFVKPDNEIVDYNTRFSGVTEADLADTSVTLRDVQAVLLSMFSADTILIGHSLESDLLALKVIHSTVVDTSVLFPHRLGLPYKRSLRNLMADYLRQIIQDNVDGHSSSEDAGACMHLVIWKVREDAKTKR

SEQ ID NO: 538 - protein, 69 aa, Homo sapiens [sequence omitted]

SEQ ID NO: 539 - protein, 225 aa, Homo sapiens
MNSNVENLPPHIIRLVYKEVTTLTADPPDGIKVFPNEEDLTDLQVTIEGPEGTPYAGGLFRMKLLLGKDFPASPPKGYFLTKIFHPNVGANGEICVNVLKRDWTAELGIRHVLLTIKCLLIHPNPESALNEEAGRLLLENYEEYAARARLLTEIHGGAGGPSGRAEAGRALASGTEASSTDPGAPGGPGGAEGPMAKKHAGERDKKLAAKKKTDKKRALRALRRL

SEQ ID NO: 540 - protein, 619 aa, Homo sapiens
MVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 541 - protein, 269 aa, Homo sapiens
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 542 - protein, 138 aa, Homo sapiens
MATKRLFGATRTWAGWGAWELLNPATSGRLLARDYAKKPVMKGAKSGKGAVTSEALKDPDVCTDPVQLTTYAMGVNIYKEGQDVPLKPDAEYPEWLFEMNLGPPKTLEELDPESREYWRRLRKQNIWRHNRLSKNKRL

SEQ ID NO: 543 - protein, 313 aa, Homo sapiens
MPVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAIVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 544 - protein, 243 aa, Homo sapiens
MAVQISKKRKFVADGIFKAELNEFLTRELAEDGYSGVEVRVTPTRTEIIILATRTQNVLGEKGRRIRELTAVVQKRFGFPEGSVELYAEKVATRGLCAIAQAESLRYKLLGGLAVRRACYGVLRFIMESGAKGCEVVVSGKLRGQRAKSMKFVDGLMIHSGDPVNYYVDTAVRHVLLRQGVLGIKVKIMLPWDPTGKIGPKKPLPDHVSIVEPKDEILPTTPISEQKGGKPEPPAMPQPVPTA

SEQ ID NO: 545 - protein, 286 aa, Homo sapiens
MMPEFQKSSVRIKNPTRVEEIICGLIKGGAAKLQIITDFDMTLSRFSYKGKRCPTCHNIIDNCKLVTDECRKKLLQLKEKYYAIEVDPVLTVEEKYPYMVEWYTKSHGLLVQQALPKAKLKEIVAESDVMLKEGYENFFDKLQQHSIPVFIFSAGIGDVLEEVIRQAGVYHPNVKVVSNFMDFDETGVLKGFKGELIHVFNKHDGALRNTEYFNQLKDNSNIILLGDSQGDLRMADGVANVEHILKIGYLNDRVDELLEKYMDSYDIVLVQDESLEVANSILQKIL

SEQ ID NO: 546 - protein, 218 aa, Homo sapiens
MGTRDDEYDYLFKVVLIGDSGVGKSNLLSRFTRNEFNLESKSTIGVEFATRSIQVDGKTIKAQIWDTAGQERYRRITSAYYRGAVGALLVYDIAKHLTYENVERWLKELRDHADSNIVIMLVGNKSDLRHLRAVPTDEARAFAEKNNLSFIETSALDSTNVEEAFKNILTEIYRIVSQKQIADRAAHDESPGNNVVDISVPPTTDGQKPNKLQCCQNL

SEQ ID NO: 547 - protein, 99 aa, Homo sapiens
MDLIGFGYAALVTFGSIFGYKRRGGVPSLIAGLFVGCLAGYGAYRVSNDKRDVKVSLFTAFFLATIMGVRFKRSKKIMPAGLVAGLSLMMILRLVLLLL

SEQ ID NO: 548 - protein, 277 aa, Homo sapiens
MSAQAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 549 - protein, 221 aa, Homo sapiens
MSSRPGREDVGAAGARRPREPPEQELQRRREQKRRRHDAQQLQQLKHLESFYEKPPPGLIKEDETKPEDCIPDVPGNEHAREFLAHAPTKGLWMPLGKEVKVMQCWRCKRYGHRTGDKECPFFIKGNQKLEQFRVAHEDPMYDIIRDNKRHEKDVRIQQLKQLLEDSTSDEDRSSSSSSEGKEKHKKKKKKEKHKKRKKEKKKKKKRKHKSSKSNEGSDSE

SEQ ID NO: 550 - protein, 137 aa, Homo sapiens [sequence omitted]

SEQ ID NO: 551 - protein, 473 aa, Homo sapiens
MGAVLGVFSLASWVPCLCSGASCLLCSCCPNSKNSTVTRLIYAFILLLSTVVSYIMQRKEMETYLKKIPGFCEGGFKIHEADINADKDCDVLVGYKAVYRISFAMAIFFFVFSLLMFKVKTSKDLRAAVHNGFWFFKIAALIGIMVGSFYIPGGYFSSVWFVVGMIGAALFILIQLVLLVDFAHSWNESWVNRMEEGNPRLWYAALLSFTSAFYILSIICVGLLYTYYTKPDGCTENKFFISINLILCVVASIISIHPKIQEHQPRSGLLQSSLITLYTMYLTWSAMSNEPDRSCNPNLMSFITRITAPTLAPGNSTAVVPTPTPPSKSGSLLDSDNFIGLFVFVLCLLYSSIRTSTNSQVDKLTLSGSDSVILGDTTTSGASDEEDGQPRRAVDNEKEGVQYSYSLFHLMLCLASLYIMMTLTSWYSPDAKFQSMTSKWPAVWVKISSSWVCLLLYVWTLVAPLVLTSRDFS

SEQ ID NO: 552 - protein, 277 aa, Homo sapiens
MWPGILVGGARVASCRYPALGPRLAAHFPAQRPPQRTLQNGLALQRCLHATATRALPLIPIVVEQTGRGERAYDIYSRLLRERIVCVMGPIDDSVASLVIAQLLFLQSESNKKPIHMYINSPGGVVTAGLAIYDTMQYILNPICTWCVGQAASMGSLLLAAGTPGMRHSLPNSRIMIHQPSGGARGQATDIAIQAEEIMKLKKQLYNIYAKHTKQSLQVIESAMERDRYMSPMEAQEFGILDKVLVHPPQDGEDEPTLVQKEPVEAAPAAEPVPAST

SEQ ID NO: 553 - protein, 521 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 554 - protein, 632 aa, Homo sapiens
MNRYTTIRQLGDGTYGSVLLGRSIESGELIAIKKMKRKFYSWEECMNLREVKSLKKLNHANVVKLKEVIRENDHLYFIFEYMKENLYQLIKERNKLFPESAIRNIMYQILQGLAFIHKHGFFHRDLKPENLLCMGPELVKIADFGLAREIRSKPPYTDYVSTRWYRAPEVLLRSTNYSSPIDVWAVGCIMAEVYTLRPLFPGASEIDTIFKICQVLGTPKKTDWPEGYQLSSAMNFRWPQCVPNNLKTLIPNASSEAVQLLRDMLQWDPKKRPTASQALRYPYFQVGHPLGSTTQNLQDSEKPQKGILEKAGPPPYIKPVPPAQPPAKPHTRISSRQHQASQPPLHLTYPYKAEVSRTDHPSHLQEDKPSPLLFPSLHNKHPQSKITAGLEHKNGEIKPKSRRRWGLISRSTKDSDDWADLDDLDFSPSLSRIDLKNKKRQSDDTLCRFESVLDLKPSEPVGTGNSAPTQTSYQRRDTPTLRSAAKQHYLKHSRYLPGISIRNGILSNPGKEFIPPNPWSSSGLSGKSSGTMSVISKVNSVGSSSTSSSGLTGNYVPSFLKKEIGSAMQRVHLAPIPDPSPGYSSLKAMRPHPGRPFFHTQPRSTPGLIPRPPAAQPVHGRTDWASKYASRR

SEQ ID NO: 555 - protein, 999 aa, Homo sapiens
MADKVRRQRPRRRVCWALVAVLLADLLALSDTLAVMSVDLGSESMKVAIVKPGVPMEIVLNKESRRKTPVIVTLKENERFFGDSAASMAIKNPKATLRYFQHLLGKQADNPHVALYQARFPEHELTFDPQRQTVHFQISSQLQFSPEEVLGMVLNYSRSLAEDFAEQPIKDAVITVPVFFNQAERRAVLQAARMAGLKVLQLINDNTATALSYGVFRRKDINTTAQNIMFYDMGSGSTVCTIVTYQMVKTKEAGMQPQLQIRGVGFDRTLGGLEMELRLRERLAGLFNEQRKGQRAKDVRENPRAMAKLLREANRLKTVLSANADHMAQIEGLMDDVDFKAKVTRVEFEELCADLFERVPGPVQQALQSAEMSLDEIEQVILVGGATRVPRVQEVLLKAVGKEELGKNINADEAAAMGAVYQAAALSKAFKVKPFVVRDAVVYPILVEFTREVEEEPGIHSLKHNKRVLFSRMGPYPQRKVITFNRYSHDFNFHINYGDLGFLGPEDLRVFGSQNLTTVKLKGVGDSFKKYPDYESKGIKAHFNLDESGVLSLDRVESVFETLVEDSAEEESTLTKLGNTISSLFGGGTTPDAKENGTDTVQEEEESPAEGSKDEPGEQVELKEEAEAPVEDGSQPPPPEPKGDATPEGEKATEKENGDKSEAQKPSEKAEAGPEGVAPAPEGEKKQKPARKRRMVEEIGVELVVLDLPDLPEDKLAQSVQKLQDLTLRDLEKQEREKAANSLEAFIFETQDKLYQPEYQEVSTEEQREEISGKLSAASTWLEDEGVGATTVMLKEKLAELRKLCQGLFFRVEERKKWPERLSALDNLLNHSSMFLKGARLIPEMDQIFTEVEMTTLEKVINETWAWKNATLAEQAKLPATEKPVLLSKDIEAKMMALDREVQYLLNKAKFTKPRPRPKDKNGTRAEPPLNASASDQGEKVIPPAGQTEDAEPISEPEKVETGSEPGDTEPLELGGPGAEPEQKEQSTGQKRPLKNDEL

SEQ ID NO: 556 - protein, 406 aa, Homo sapiens
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 557 - protein, 330 aa, Homo sapiens
MQQQPLPGPGAPTTEPTKPPYSYIALIAMAIQSSPGQRATLSGIYRYIMGRFAFYRHNRPGWQNSIRHNLSLNECFVKVPRDDRKPGKGSYWTLDPDCHDMFEHGSFLRRRRRFTRQTGAEGTRGPAKARRGPLRATSQDPGVPNATTGRQCSFPPELPDPKGLSFGGLVGAMPASMCPATTDGRPRPPMEPKEISTPKPACPGELPVATSSSSCPAFGFPAGFSEAESFNKAPTPVLSPESGIGSSYQCRLQALNFCMGADPGLEHLLASAAPSPAPPTPPGSLRAPLPLPTDHKEPWVAGGFPVQGGSGYPLGLTPCLYRTPGMFFFE

SEQ ID NO: 558 - protein, 216 aa, Homo sapiens
MSFLFGSRSSKTFKPKKNIPEGSHQYELLKHAEATLGSGNLRMAVMLPEGEDLNEWVAVNTVDFFNQINMLYGTITDFCTEESCPVMSAGPKYEYHWADGTNIKKPIKCSAPKYIDYLMTWVQDQLDDETLFPSKIGVPFPKNFMSVAKTILKRLFRVYAHIYHQHFDPVIQLQEEAHLNTSFKHFIFFVQEFNLIDRRELAPLQELIEKLTSKDR

SEQ ID NO: 559 - protein, 700 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 560 - protein, 1065 aa, Homo sapiens
MAPAPLGVPEEQLLGCRSRVLSRLLFIAQTALLLLPAAGAGLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 561 - protein, 1107 aa, Homo sapiens
MDGKRRPGPGPGVPPKRARGGLWDDDDAPWPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSHTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 562 - protein, 345 aa, Homo sapiens
MSHLFDPRLPALAASPMLYLYGPERPGLPLAFAPAAALAASGRAETPQKPPYSYIALIAMAIQDAPEQRVTLNGIYQFIMDRFPFYHDNRQGWQNSIRHNLSLNDCFVKVPREKGRPGKGSYWTLDPRCLDMFENGNYRRRKRKPKPGPGAPEAKRPRAETHQRSAEAQPEAGSGAGGSGPAISRLQAAPAGPSPLLDGPSPPAPLHWPGTASPNEDAGDAAQGAAAVAVGQAARTGDGPGSPLRPASRSSPKSSDKSKSFSIDSILAGKQGQKPPSGDELLGGAKPGPGGRLGASLLAASSSLRPPFNASLMLDPHVQGGFYQLGIPFLSYFPLQVPDTVLHFQ

SEQ ID NO: 563 - protein, 428 aa, Homo sapiens
MDSLWGPGAGSHPFGVHNTRLSPDLCPGKIVLRALKESGAGMPEQDKDPRVQENPGDQRRVPEVTGDARPAFRPLRDNGGLSPFVPGPGPLQTDLHAQRSEIRYNQTSQTSWTSSCTNRNAISSSYSSTGGLPGLKRRRGPASSHCQLTLSSSKTVSEDRPQAVSSGHTQCEKAADIAPGQTLTLRNDSSTSEASRPSTHKFPLLPRRRGEPLMLPPPLELGYRVTVEDLDREKEAAFQRINSALQVEDKAISDCRPSRPSHTLSSLATGASGLPAVSKAPSMDAQQETHKSQDCLGLLDPLASAAGVPSTAPMSGKKHRPPGPLFSSSDPLPATSSDSQDSAQVTSLIPAPFPAASMDAGMRRTRHGTSAPAAAAAAPPRSTLNPTLGSLLEWMEALHISGPQPQLQQVPRGQNQRSQTSWTSSCPK

SEQ ID NO: 564 - protein, 659 aa, Homo sapiens
MLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 565 - protein, 250 aa, Homo sapiens [sequence omitted]

SEQ ID NO: 566 - protein, 454 aa, Homo sapiens
MDPGQQPPPQPAPQGQGQPPSQPPQGQGPPSGPGQPAPAATQAAPQAPPAGHQIVHVRGDSETDLEALFNAVMNPKTANVPQTVPMRLRKLPDSFFKPPEPKSHSRQASTDAGTAGALTPQHVRAHSSPASLQLGAVSPGTLTPTGVVSGPAATPTAQHLRQSSFEIPDDVPLPAGWEMAKTSSGQRYFLNHIDQTTTWQDPRKAMLSQMNVTAPTSPPVQQNMMNSASAMNQRISQSAPVKQPPPLAPQSPQGGVMGGSNSNQQQQMRLQQLQMEKERLRLKQQELLRQVRPQELALRSQLPTLEQDGGTQNPVSSPGMSQELRTMTTNSSDPFLNSGTYHSRDESTDSGLSMSSYSVPRTPDDFLNSVDEMDTGDTINQSTLPSQQNRFPDYLEAIPGTNVDLGTLEGDGMNIEGEELMPSLQEALSSDILNDMESVLAATKLDKESFLTWL

SEQ ID NO: 567 - protein, 575 aa, Homo sapiens
MADRGGVGEAAAVGASPASVPGLNPTLGWRERLRAGLAGTGASLWFVAGLGLLYALRIPLRLCENLAAVTVFLNSLTPKFYVALTGTSSLISGLIFIFEWWYFHKHGTSFIEQVSVSHLQPLMGGTESSISEPGSPSRNRENETSRQNLSECKVWRNPLNLFRGAEYRRYTWVTGKEPLTYYDMNLSAQDHQTFFTCDTDFLRPSDTVMQKAWRERNPPARIKAAYQALELNNDCATAYVLLAEEEATTIVDAERLFKQALKAGETIYRQSQQCQHQSPQHEAQLRRDTNVLVYIKRRLAMCARKLGRIREAVKIMRDLMKEFPPLTMLNIHENLLESLLELQAYPDVQAVLAKYDDISLPKSAAICYTAALLKTRTVSEKFSPETASRRGLSTAEINAVEAIHRAVEFNPHVPKYLLEMKSLILPPEHILKRGDSEAIAYAFFHLQHWKRIEGALNLLQCTWEGTFRMIPYPLEKGHLFYPYPSCTETADRELLPTFHHVSVYPKKELPLFIHFTAGFCSSTAMIAILTHQFPEIMGIFAKAVLGLWCPQPWASSGFEENTQDLKSEDLGLSSG

SEQ ID NO: 568 - protein, 128 aa, Homo sapiens
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 569 - protein, 295 aa, Homo sapiens
MGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 570 - protein, 1139 aa, Homo sapiens
MPSGGDQSPPPPPPPPAAAASDEEEEDDGEAEDAAPSAESPTPQIQQRFDELCSRLNMDEAARPEAWDSYRSMSESYTLEGNDLHWLACALYVACRKSVPTVSKGTVEGNYVSLTRILKCSEQSLIEFFNKMKKWEDMANLPPHFRERTERLERNFTVSAVIFKKYEPIFQDIFKYPQEEQPRQQRGRKQRRQPCTVSEIFHFCWVLFIYAKGNFPMISDDLVNSYHLLLCALDLVYGNALQCSNRKELVNPNFKGLSEDFHAKDSKPSSDPPCIIEKLCSLHDGLVLEAKGIKEHFWKPYIRKLYEKKLLKGKEENLTGFLEPGNFGESFKAINKAYEEYVLSVGNLDERIFLGEDAEEEIGTLSRCLNAGSGTETAERVQMKNILQQHFDKSKALRISTPLTGVRYIKENSPCVTPVSTATHSLSRLHTMLTGLRNAPSEKLEQILRTCSRDPTQAIANRLKEMFEIYSQHFQPDEDFSNCAKEIASKHFRFAEMLYYKVLESVIEQEQKRLGDMDLSGILEQDAFHRSLLACCLEVVTFSYKPPGNFPFITEIFDVPLYHFYKVIEVFIRAEDGLCREVVKHLNQIEEQILDHLAWKPESPLWEKIRDNENRVPTCEEVMPPQNLERADEICIAGSPLTPRRVTEVRADTGGLGRSITSPTTLYDRYSSPPASTTRRRLFVENDSPSDGGTPGRMPPQPLVNAVPVQNVSGETVSVTPVPGQTLVTMATATVTANNGQTVTIPVQGIANENGGITFFPVQVNVGGQAQAVTGSIQPLSAQALAGSLSSQQVTGTTLQVPGQVAIQQISPGGQQQKQGQSVTSSSNRPRKTSSLSLFFRKVYHLAAVRLRDLCAKLDISDELRKKIWTCFEFSIIQCPELMMDRHLDQLLMCAIYVMAKVTKEDKSFQNIMRCYRTQPQARSQVYRSVLIKGKRKRRNSGSSDSRSHQNSPTELNKDRTSRDSSPVMRSSSTLPVPQPSSAPPTPTRLTGANSDMEEEERGDLIQFYNNIYIKQIKTFAMKYSQANMDAPPLSPYPFVRTGSPRRIQLSQNHPVYISPHKNETMLSPREKIFYYFSNSPSKRLREINSMIRTGETPTKKRGILLEDGSESPAKRICPENHSALLRRLQDVANDRGSH

SEQ ID NO: 571 - protein, 514 aa, Homo sapiens
MLTRVKSAVANFMGGIMAGSSGSEHGGGSCGGSDLPLRFPYGRPEFLGLSQDEVECSADHIARPILILKETRRLPWATGYAEVINAGKSTHNEDQASCEVLTVKKKAGAVTSTPNRNSSKRRSSLPNGEGLQLKENSESEGVSCHYWSLFDGHAGSGAAVVASRLLQHHITEQLQDIVDILKNSAVLPPTCLGEEPENTPANSRTLTRAASLRGGVGAPGSPSTPPTRFFTEKKIPHECLVIGALESAFKEMDLQIERERSSYNISGGCTALIVICLLGKLYVANAGDSRAIIIRNGEIIPMSSEFTPETERQRLQYLAFMQPHLLGNEFTHLEFPRRVQRKELGKKMLYRDFNMTGWAYKTIEDEDLKFPLIYGEGKKARVMATIGVTRGLGDHDLKVHDSNIYIKPFLSSAPEVRIYDLSKYDHGSDDVLILATDGLWDVLSNEEVAEAITQFLPNCDPDDPHRYTLAAQDLVMRARGVLKDRGWRISNDRLGSGDDISVYVIPLIHGNKLS

SEQ ID NO: 572 - protein, 447 aa, Homo sapiens
MAGAGGGNDIQWCFSQVKGAVDDDVAEADIISTVEFNHSGELLATGDKGGRVVIFQQEQENKIQSHSRGEYNVYSTFQSHEPEFDYLKSLEIEEKINKIRWLPQKNAAQFLLSTNDKTIKLWKISERDKRPEGYNLKEEDGRYRDPTTVTTLRVPVFRPMDLMVEASPRRIFANAHTYHINSISINSDYETYLSADDLRINLWHLEITDRSFNIVDIKPANMEELTEVITAAEFHPNSCNTFVYSSSKGTIRLCDMRASALCDRHSKLFEEPEDPSNRSFFSEIISSISDVKFSHSGRYMMTRDYLSVKIWDLNMENRPVETYQVHEYLRSKLCSLYENDCIFDKFECCWNGSDSVVMTGSYNNFFRMFDRNTKRDITLEASRENNKPRTVLKPRKVCASGKRKKDEISVDSLDFNKKILHTAWHPKENIIAVATTNNLYIFQDKVN

SEQ ID NO: 573 - protein, 124 aa, Homo sapiens
MSYIPGQPVTAVVQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 574 - protein, 1270 aa, Homo sapiens
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 575 - protein, 324 aa, Homo sapiens
MPLFNSLCWFPTIHVTPPSFILNGIPGLERVHVWISLPLCTMYIIFLVGNLGLVYLIYYEESLHHPMYFFFGHALSLIDLLTCTTTLPNALCIFWFSLKEINFNACLAQMFFVHGFTGVESGVLMLMALDRYVAICYPLRYATTLTNPIIAKAELATFLRGVLLMIPFPFLVKRLPFCQSNIISHTYCDHMSVVKLSCASIKVNVIYGLMVALLIGVFDICCISLSYTLILKAAISLSSSDARQKAFSTCTAHISAIIITYVPAFFTFFAHRFGGHTIPPSLHIIVANLYLLLPPTLNPIVYGVKTKQIRKSVIKFFQGDKGAG

SEQ ID NO: 576 - protein, 393 aa, Homo sapiens [sequence omitted]

SEQ ID NO: 577 - protein, 177 aa, Homo sapiens
MAVSFLQLHPREDACIPNTNYGVLLIEFFELYGRHFNYLKTGIRIKDGGSYVAKDEVQKNMLDGYRPSMLYIEDPLQPGNDVGRSSYGAMQVKQAFDYAYVVLSHAVSPIAKYYPNNETESILGRIIRVTDEVATYRDWISKQWGLKNRPEPSCNGNETLHQVQCRPLLPHSPALVT

SEQ ID NO: 578 - protein, 452 aa, Homo sapiens
MDGTIKEALSVVSDDQSLFDSAYGAAAHLPKADMTASGSPDYGQPHKINPLPPQQEWINQPVRVNVKREYDHMNGSRESPVDCSVSKCSKLVGGGESNPMNYNSYMDEKNGPPPPNMTTNERRVIVPADPTLWTQEHVRQWLEWAIKEYSLMEIDTSFFQNMDGKELCKMNKEDFLRATTLYNTEVLLSHLSYLRESSLLAYNTTSHTDQSSRLSVKEDPSYDSVRRGAWGNNMNSGLNKSPPLGGAQTISKNTEQRPQPDPYQILGPTSSRLANPGSGQIQLWQFLLELLSDSANASCITWEGTNGEFKMTDPDEVARRWGERKSKPNMNYDKLSRALRYYYDKNIMTKVHGKRYAYKFDFHGIAQALQPHPTESSMYKYPSDISYMPSYHAHQQKVNFVPPHPSSMPVTSSSFFGAASQYWTSPTGGIYPNPNVPRHPNTHVPSHLGSYY

SEQ ID NO: 579 - protein, 268 aa, Homo sapiens
MSGKHYKGPEVSCCIKYFIFGFNVIFWFLGITFLGIGLWAWNEKGVLSNISSITDLGGFDPVWLFLVVGGVMFILGFAGCIGALRENTFLLKFFSVFLGIIFFLELTAGVLAFVFKDWIKDQLYFFINNNIRAYRDDIDLQNLIDFTQEYWQCCGAFGADDWNLNIYFNCTDSNASRERCGVPFSCCTKDPAEDVINTQCGYDARQKPEVDQQIVIYTKGCVPQFEKWLQDNLTIVAGIFIGIALLQIFGICLAQNLVSDIEAVRASW

SEQ ID NO: 580 - protein, 807 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIGMACMEYEMGKKKCERYWAEPVEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSPLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTSGKSFTRSKSLKILRNMKKSICNSCPPNKPAESVQSNNSSSFLNFGFANRFSKPKGPRNPPPTWNI

SEQ ID NO: 581 - protein, 693 aa, Homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 582 - protein, 1214 aa, Homo sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 583 - protein, 321 aa, Homo sapiens
MSGDNSSSLTPGFFILNGVPGLEATHIWISLPFCFMYIIAVVGNCGLICLISHEEALHRPMYYFLALLSFTDVTLCTTMVPNMLCIFWFNLKEIDFNACLAQMFFVHMLTGMESGVLMLMALDRYVAICYPLRYATILTNPVIAKAGLATFLRNVMLIIPFTLLTKRLPYCRGNFIPHTYCDHMSVAKVSCGNFKVNAIYGLMVALLIGVFDICCISVSYTMILQAVMSLSSADARHKAFSTCTSHMCSIVITYVAAFFTFFTHRFVGHNIPNHIHIIVANLYLLLPPTMNPIVYGVKTKQIQEGVIKFLLGDKVSFTYDK

SEQ ID NO: 584 - protein, 478 aa, Homo sapiens
MAPKKKGKKGKAKGTPIVDGLAPEDMSKEQVEEHVSRIREELDREREERNYFQLERDKIHTFWEITRRQLEEKKAELRNKDREMEEAEERHQVEIKVYKQKVKHLLYEHQNNLTEMKAEGTVVMKLAQKEHRIQESVLRKDMRALKVELKEQELASEVVVKNLRLKHTEEITRMRNDFERQVREIEAKYDKKMKMLRDELDLRRKTELHEVEERKNGQIHTLMQRHEEAFTDIKNYYNDITLNNLALINSLKEQMEDMRKKEDHLEREMAEVSGQNKRLADPLQKAREEMSEMQKQLANYERDKQILLCTKARLKVREKELKDLQWEHEVLEQRFTKVQQERDELYRKFTAAIQEVQQKTGFKNLVLERKLQALSAAVEKKEVQFNEVLAASNLDPAALTLVSRKLEDVLESKNSTIKDLQYELAQVCKAHNDLLRTYEAKLLAFGIPLDNVGFKPLETAVIGQTLGQGPAGLVGTPT

SEQ ID NO: 585 - protein, 655 aa, Homo sapiens
MATPVVTKTAWKLQEIVAHASNVSSLVLGKASGRLLATGGDDCRVNLWSINKPNCIMSLTGHTSPVESVRLNTPEELIVAGSQSGSIRVWDLEAAKILRTLMGLKANICSLDFHPYGEFVASGSQDTNIKLWDIRRKGCVFRYRGHSQAVRCLRFSPDGKWLASAADDHTVKLWDLTAGKMMSEFPGHTGPVNVVEFHPNEYLLASGSSDGTIRFWDLEKFQVVSRIEGEPGPVRSVLFNPDGCCLYSGCQDSLRVYGWEPERCFDVVLVNWGKVADLAICNDQLIGVAFSQSNVSSYVVDLTRVTRTGTVARDPVQDHRPLAQPLPNPSAPLRRIYERPSTTCSKPQRVKQNSESERRSPSSEDDRDERESRAEIQNAEDYNEIFQPKNSISRTPPRRSEPFPAPPEDDAATAKEAAKPSPAMDVQFPVPNLEVLPRPPVVASTPAPKAEPAIIPATRNEPIGLKASDFLPAVKIPQQAELVDEDAMSQIRKGHDTMCVVLTSRHKNLDTVRAVWTMGDIKTSVDSAVAINDLSVVVDLLNIVNQKASLWKLDLCTTVLPQIEKLLQSKYESYVQTGCTSLKLILQRFLPLITDMLAAPPSVGVDISREERLHKCRLCYKQLKSISGLVKSKSGLSGRHGSTFRELHLLMASLD

SEQ ID NO: 586 - protein, 943 aa, Homo sapiens
MAASGLDHLKNGYRRRFCRPSRARDINTEQGQNVLEILQDCFEEKSLANDFSTNSTKSVPNSTRKIKDTCIQSPSKECQKSHPKSVPVSSKKKEASLQFVVEPSEATNRSVQAHEVHQKILATDVSSKNTPDSKKISSRNINDHHSEADEEFYLSVGSPSVLLDAKTSVSQNVIPSSAKKRETYTFENSVNMLPSSTEVSVKTKKRLNFDDKVMLKKIEIDNKVSDEEDKTSEGQERKPSGSSQNRIRDSEYEIQRQAKKSFSTLFLETVKRKSESSPIVRHAATAPPHSCPPDDTKLIEDEFIIDESDQSFASRSWITIPRKAGSLKQRTISPAESTALFQGRKSREKHHNILPKTLANDKHSHKPHPVETSQPSDKTVLDTSYALIDETVNNYRSTKYEMYSKNAEKPSRSKRTIKQKQRRKFMAKPAEEQLDVGQSKDENIHTSHITQDEFQRNSDRNMEEHEEMGNDCVSKKQMPPVGSKKSSTRKDKEESKKKRFSSESKNKLVPEEVTSTVTKSRRISRRPSDWWVVKSEESPVYSNSSVRNELPMHHNSSRKSTKKTNQSSKNIRKKTIPLKRQKTATKGNQRVQKFLNAEGSGGIVGHDEISRCSLSEPLESDEADLAKKKNLDCSRSTRSSKNEDNIMTAQNVPLKPQTSGYTCNIPTESNLDSGEHKTSVLEESGPSRLNNNYLMSGKNDVDDEEVHGSSDDSKQSKVIPKNRIHHKLVLPSNTPNVRRTKRTRLKPLEYWRGERIDYQGRPSGGFVISGVLSPDTISSKRKAKENIGKVNKKSNKKRICLDNDERKTNLMVNLGIPLGDPLQPTRVKDPETREIILMDLVRPQDTYQFFVKHGELKVYKTLDTPFFSTGKLILGPQEEKGKQHVGQDILVFYVNFGDLLCTLHETPYILSTGDSFYVPSGNYYNIKNLRNEESVLLFTQIKR

SEQ ID NO: 587 - protein, 694 aa, Homo sapiens
MVENERLRQEMRRCEAELQELRTKPAGPCPGCEHSQESAQLRDKLSQLQLEMAESKGMLSELNLEVQQKTDRLAEVELRLKDCLAEKAQEEERLSRRLRDSHETIASLRAQSPPVKYVIKTVEVESSKTKQALSESQARNQHLQEQVAMQRQVLKEMEQQLQSSHQLTARLRAQIAMYESELERAHGQMLEEMQSLEEDKNRAIEEAFARAQVEMKAVHENLAGVRTNLLTLQPALRTLTNDYNGLKRQVRGFPLLLQEALRSVKAEIGQAIEEVNSNNQELLRKYRRELQLRKKCHNELVRLKGNIRVIARVRPVTKEDGEGPEATNAVTFDADDDSIIHLLHKGKPVSFELDKVFSPQASQQDVFQEVQALVTSCIDGFNVCIFAYGQTGAGKTYTMEGTAENPGINQRALQLLFSEVQEKASDWEYTITVSAAEIYNEVLRDLLGKEPQEKLEIRLCPDGSGQLYVPGLTEFQVQSVDDINKVFEFGHTNRTTEFTNLNEHSSRSHALLIVTVRGVDCSTGLRTTGKLNLVDLAGSERVGKSGAEGSRLREAQHINKSLSALGDVIAALRSRQGHVPFRNSKLTYLLQDSLSGDSKTLMVVQVSPVEKNTSETLYSLKFAERVRSVELGPGLRRAELGSWSSQEHLEWEPACQTPQPSARAHSAPSSGTSSRPGSIRRKLQPSGKSRPLPV

SEQ ID NO: 588 - protein, 467 aa, Homo sapiens [sequence omitted]

SEQ ID NO: 589 - protein, 551 aa, Homo sapiens
MNESPDPTDLAGVIIELGPNDSPQTSEFKGATEEAPAKESPHTSEFKGAARVSPISESVLARLSKFEVEDAENVASYDSKIKKIVHSIVSSFAFGLFGVFLVLLDVTLILADLIFTDSKLYIPLEYRSISLAIALFFLMDVLLRVFVERRQQYFSDLFNILDTAIIVILLLVDVVYIFFDIKLLRNIPRWTHLLRLLRLIILLRIFHLFHQKRQLEKLIRRRVSENKRRYTRDGFDLDLTYVTERIIAMSFPSSGRQSFYRNPIKEVVRFLDKKHRNHYRVYNLCSERAYDPKHFHNRVVRIMIDDHNVPTLHQMVVFTKEVNEWMAQDLENIVAIHCKGGTDRTGTMVCAFLIASEICSTAKESLYYFGERRTDKTHSEKFQGVETPSQKRYVAYFAQVKHLYNWNLPPRRILFIKHFIIYSIPRYVRDLKIQIEMEKKVVFSTISLGKCSVLDNITTDKILIDVFDGLPLYDDVKVQFFYSNLPTYYDNCSFYFWLHTSFIENNRLYLPKNELDNLHKQKARRIYPSDFAVEILFGEKMTSSDVVAGSD

SEQ ID NO: 590 - protein, 704 aa, Homo sapiens
MANENHGSPREEASLLSHSPGTSNQSQPCSPKPIRLVQDLPEELVHAGWEKCWSRRENRPYYFNRFTNQSLWEMPVLGQHDVISDPLGLNATPLPQDSSLVETPPAENKPRKRQLSEEQPSGNGVKKPKIEIPVTPTGQSVPSSPSIPGTPTLKMWGTSPEDKQQAALLRPTEVYWDLDIQTNAVIKHRGPSEVLPPHPEVELLRSQLILKLRQHYRELCQQREGIEPPRESFNRWMLERKVVDKGSDPLLPSNCEPVVSPSMFREIMNDIPIRLSRIKFREEAKRLLFKYAEAARRLIESRSASPDSRKVVKWNVEDTFSWLRKDHSASKEDYMDRLEHLRRQCGPHVSAAAKDSVEGICSKIYHISLEYVKRIREKHLAILKENNISEEVEAPEVEPRLVYCYPVRLAVSAPPMPSVEMHMENNVVCIRYKGEMVKVSRNYFSKLWLLYRYSCIDDSAFERFLPRVWCLLRRYQMMFGVGLYEGTGLQGSLPVHVFEALHRLFGVSFECFASPLNCYFRQYCSAFPDTDGYFGSRGPCLDFAPLSGSFEANPPFCEELMDAMVSHFERLLESSPEPLSFIVFIPEWREPPTPALTRMEQSRFKRHQLILPAFEHEYRSGSQHICKKEEMHYKAVHNTAVLFLQNDPGFAKWAPTPERLQELSAAYRQSGRSHSSGSSSSSSSEAKDRDSGREQGPSREPHPT

SEQ ID NO: 591 - protein, 1245 aa, Homo sapiens
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSHRVLTWLMKGVEKVIPQPVHSITEDPAQILGHGSTGDTGCTDEPNEALEAQDTRPGLRLLLWLEQNLERVLPQPPKSSEVWRDEPAVATAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 592 - protein, 1021 aa, Homo sapiens
MAGISYVASFFLLLTKLSIGQREVTVQKGPLFRAEGYPVSIGCNVTGHQGPSEQHFQWSVYLPTNPTQEVQIISTKDAAFSYAVYTQRVRGGDVYVERVQGNSVLLHISKLQMKDAGEYECHTPNTDENYYGSYRAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQLSKLGPKAFSLKIFSLGPEDEGAYRCVVAEVMKTRTGSWQVLQRKQSPDSHVHLRKPAARSVVVSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQGQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 593 - protein, 184 aa, Homo sapiens
MGNGMNKILPGLYIGNFKDARDAEQLSKNKVTHILSVHDSARPMLEGVKYLCIPAADSPSQNLTRHFKESIKFIHECRLRGESCLVHCLAGVSRSVTLVIAYIMTVTDFGWEDALHTVRAGRSCANPNVGFQRQLQEFEKHEVHQYRQWLKEEYGESPLQDAEEAKNILAAPGILKFWAFLRRL

SEQ ID NO: 594 - protein, 798 aa, Homo sapiens
MAASLPGPGSRLFRTYGAADGRRQRRPGREAAQWFPPQDRRRFFNSSGSSDASIGDPSQSDDPDDPDDPDFPGSPVRRRRRCPGGRVPKDRPSLTVTPKRWKLRARPSLTVTPRRLGLRARPPQKCSTPCGPLRLPPFPSRDSGRLSPDLSVCGQPRDGDELGISASLFSSLASPCPGSPTPRDSVISIGTSACLVAASAVPSDLHLPEVSLDRASLPCSQEEATGGAKDTRMVHQTRASLRSVLFGLMNSGTPEDSEFRADGKNMRESCCKRKLVVGNGPEGPGLSSTGKRRATGQDSCQERGLQEAVRREHQEASVPKGRIVPRGTDRLERTRSSRKSKHQEATETSLLHSHRFKKGQKLGKDSFPTQDLTPLQNACFWTKTRASFSFHKKKIVTDVSEVCSIYTTATSLSGSLLSECSNRPVMNRTSGAPSSWHSSSMYLLSPLNTLSISNKKASDAEKVYGECSQKGPVPFSHCLPTEKLQRCEKIGEGVFGEVFQTIADHTPVAIKIIAIEGPDLVNGSHQKTFEEILPEIIISKELSLLSGEVCNRTEGFIGLNSVHCVQGSYPPLLLKAWDHYNSTKGSANDRPDFFKDDQLFIVLEFEFGGIDLEQMRTKLSSLATAKSILHQLTASLAVAEASLRFEHRDLHWGNVLLKKTSLKKLHYTLNGKSSTIPSCGLQVSIIDYTLSRLERDGIVVFCDVSMDEDLFTGDGDYQFDIYRLMKKENNNRWGEYHPYSNVLWLHYLTDKMLKQMTFKTKCNTPAMKQIKRKIQEFHRTMLNFSSATDLLCQHSLFK

SEQ ID NO: 595 - protein, 387 aa, Homo sapiens
MAGKAAAPGTAVLLVTANVGSLFDDPENLQKNWLREFYQVVHTHKPHFMALHCQEFGGKNYEASMSHVDKFVKELLSSDAMKEYNRARVYLDENYKSQEHFTALGSFYFLHESLKNIYQFDFKAKKYRKVAGKEIYSDTLESTPMLEKEKFPQDYFPECKWSRKGFIRTRWCIADCAFDLVNIHLFHDASNLVAWETSPSVYSGIRHKALGYVLDRIIDQRFEKVSYFVFGDFNFRLDSKSVVETLCTKATMQTVRAADTNEVVKLIFRESDNDRKVMLQLEKKLFDYFNQEVFRDNNGTALLEFDKELSVFKDRLYELDISFPPSYPYSEDARQGEQYMNTRCPAWCDRILMSPSAKELVLRVSVCCPSPGHRGMWSAGSGLAQPW

SEQ ID NO: 596 - protein, 337 aa, Homo sapiens
MTMMAHQYPSWIFINEKTFITREQLNSLLKTYNIFYENQKNLHILYGETEDGKLIVEGMLDIFWGVKRPIQLKIQDEKPFSSFTSMKSSDVFSSKGMTRWGEFDDLYRISELDRTQIPMSEKRNSQEDYLSYHSNTLKPHAKDEPDSPVLYRTMSEAALVRKRMKPLMMDRKERQKNRASINGHFYNHETSIFIPAFESETKVRVNSNMRTEEVIKQLLQKFKIENSPQDFALHIIFATGEQRRLKKTDIPLLQRLLQGPSEKNARIFLMDKDAEEISSDVAQYINFHFSLLESILQRLNEEEKREIQRIVTKFNKEKAIILKCLQNKLVIKTETTV

SEQ ID NO: 597 - protein, 2537 aa, Homo sapiens
MESEEEQHMTTLLCMGFSDPATIRKALRLAKNDINEAVALLTNERPGLDYGGYEPMDSGGGGGFDPPPAYHEVVDAEKNDENGNCSGEGIEFPTTNLYELESRVLTDHWSIPYKREESLGKCLLASTYLARLGLSESDENCRRFMDRCMPEAFKKLLTSSAVHKWGTEIHEGIYNMLMLLIELVAERIKQDPIPTGLLGVLTMAFNPDNEYHFKNRMKVSQRNWAEVFGEGNMFAVSPVSTFQKEPHGWVVDLVNKFGELGGFAAIQAKLHSEDIELGAVSALIQPLGVCAEYLNSSVVQPMLDPVILTTIQDVRSVEEKDLKDKRLVSIPELLSAVKLLCMRFQPDLVTIVDDLRLDILLRMLKSPHFSAKMNSLKEVTKLIEDSTLSKSVKNAIDTDRLLDWLVENSVLSIALEGNIDQAQYCDRIKGIIELLGSKLSLDELTKIWKIQSGQSSTVIENIHTIIAAAAVKFNSDQLNHLFVLIQKSWETESDRVRQKLLSLIGRIGREARFETTSGKVLDVLWELAHLPTLPSSLIQQALEEHLTILSDAYAVKEAIKRSYIIKCIEDIKRSIIQDLKKNFEIVKLVTGSLIACHRLAAAVAGPGGLSGSTLVDGRYTYREYLEAHLKFLAFFLQEATLYLGWNRAKEIWECLVTGQDVCELDREMCFEWFTKGQHDLESDVQQQLFKEKILKLESYEITMNGFNLFKTFFENVNLCDHRLKRQGAQLYVEKLELIGMDFIWKIAMESPDEEIANEAIQLIINYSYINLNPRLKKDSVSLHKKFIADCYTRLEAASSALGGPTLTHAVTRATKMLTATAMPTVATSVQSPYRSTKLVIIERLLLLAERYVITIEDFYSVPRTILPHGASFHGHLLTLNVTYESTKDTFTVEAHSNETIGSVRWKIAKQLCSPVDNIQIFTNDSLLTVNKDQKLLHQLGFSDEQILTVKTSGSGTPSGSSADSSTSSSSSSSGVFSSSYAMEQEKSLPGVVMALVCNVFDMLYQLANLEEPRITLRVRKLLLLIPTDPAIQEALDQLDSLGRKKTLLSESSSQSSKSPSLSSKQQHQPSASSILESLFRSFAPGMSTFRVLYNLEVLSSKLMPTADDDMARSCAKSFCENFLKAGGLSLVVNVMQRDSIPSEVDYETRQGVYSICLQLARFLLVGQTMPTLLDEDLTKDGIEALSSRPFRNVSRQTSRQMSLCGTPEKSSYRQLSVSDRSSIRVEEIIPAARVAIQTMEVSDFTSTVACFMRLSWAAAAGRLDLVGSSQPIKESNSLCPAGIRNRLSSSGSNCSSGSEGEPVALHAGICVRQQSVSTKDSLIAGEALSLLVTCLQLRSQQLASFYNLPCVADFIIDILLGSPSAEIRRVACDQLYTLSQTDTSAHPDVQKPNQFLLGVILTAQLPLWSPTSIMRGVNQRLLSQCMEYFDLRCQLLDDLTTSEMEQLRISPATMLEDEITWLDNFEPNRTAECETSEADNILLAGHLRLIKTLLSLCGAEKEMLGSSLIKPLLDDFLFRASRIILNSHSPAGSAAISQQDFHPKCSTANSRLAAYEVLVMLADSSPSNLQIIIKELLSMHHQPDPALTKEFDYLPPVDSRSSSGFVGLRNGGATCYMNAVFQQLYMQPGLPESLLSVDDDTDNPDDSVFYQVQSLFGHLMESKLQYYVPENFWKIFKMWNKELYVREQQDAYEFFTSLIDQMDEYLKKMGRDQIFKNTFQGIYSDQKICKDCPHRYEREEAFMALNLGVTSCQSLEISLDQFVRGEVLEGSNAYYCEKCKEKRITVKRTCIKSLPSVLVIHLMRFGFDWESGRSIKYDEQIRFPWMLNMEPYTVSGMARQDSSSEVGENGRSVDQGGGGSPRKKVALTENYELVGVIVHSGQAHAGHYYSFIKDRRGCGKGKWYKFNDTVIEEFDLNDETLEYECFGGEYRPKVYDQTNPYTDVRRRYWNAYMLFYQRVSDQNSPVLPKKSRVSVVRQEAEDLSLSAPSSPEISPQSSPRPHRPNNDRLSILTKLVKKGEKKGLFVEKMPARIYQMVRDENLKFMKNRDVYSSDYFSFVLSLASLNATKLKHPYYPCMAKVSLQLAIQFLFQTYLRTKKKLRVDTEEWIATIEALLSKSFDACQWLVEYFISSEGRELIKIFLLECNVREVRVAVATILEKTLDSALFYQDKLKSLHQLLEVLLALLDKDVPENCKNCAQYFFLFNTFVQKQGIRAGDLLLRHSALRHMISFLLGASRQNNQIRRWSSAQAREFGNLHNTVALLVLHSDVSSQRNVAPGIFKQRPPISIAPSSPLLPLHEEVEALLFMSEGKPYLLEVMFALRELTGSLLALIEMVVYCCFCNEHFSFTMLHFIKNQLETAPPHELKNTFQLLHEILVIEDPIQVERVKFVFETENGLLALMHHSNHVDSSRCYQCVKFLVTLAQKCPAAKEYFKENSHHWSWAVQWLQKKMSEHYWTPQSNVSNETSTGKTFQRTISAQDTLAYATALLNEKEQSGSSNGSESSPANENGDRHLQQGSESPMMIGELRSDLDDVDP

SEQ ID NO: 598 - protein, 310 aa, Homo sapiens
MQLNNNVTEFILLGLTQDPFWKKIVFVIFLRLYLGTLLGNLLIIISVKTSQALKNPMFFFLFYLSLSDTCLSTSITPRMIVDALLKKTTISFSECMIQVFSSHVFGCLEIFILILTAVDRYVDICKPLHYMTIISQWVCGVLMAVAWVGSCVHSLVQIFLALSLPFCGPNVINHCFCDLQPLLKQACSETYVVNLLLVSNSGAICAVSYVMLIFSYVIFLHSLRNHSAEVIKKALSTCVSHIIVVILFFGPCIFMYTCLATVFPMDKMIAVFYTVGTSFLNPVIYTLKNTEVKSAMRKLWSKKLITDDKR

SEQ ID NO: 599 - protein, 320 aa, Homo sapiens
MSFLNGTSLTPASFILNGIPGLEDVHLWISFPLCTMYSIAITGNFGLMYLIYCDEALHRPMYVFLALLSFTDVLMCTSTLPNTLFILWFNLKEIDFKACLAQMFFVHTFTGMESGVLMLMALDHCVAICFPLRYATILTNSVIAKAGFLTFLRGVMLVIPSTFLTKRLPYCKGNVIPHTYCDHMSVAKISCGNVRVNAIYGLIVALLIGGFDILCITISYTMILQAVVSLSSADARQKAFSTCTAHFCAIVLTYVPAFFTFFTHHFGGHTIPLHIHIIMANLYLLMPPTMNPIVYGVKTRQVRESVIRFFLKGKDNSHNF

SEQ ID NO: 600 - protein, 177 aa, Homo sapiens
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEGLARSCACTSSCWGY

SEQ ID NO: 601 - protein, 2551 aa, Homo sapiens
MMLQHLVIFCLGLVVQNFCSPAETTGQARRCDRKSLLTIRTECRSCALNLGVKCPDGYTMITSGSVGVRDCRYTFEVRTYSLSLPGCRHICRKDYLQPRCCPGRWGPDCIECPGGAGSPCNGRGSCAEGMEGNGTCSCQEGFGGTACETCADDNLFGPSCSSVCNCVHGVCNSGLDGDGTCECYSAYTGPKCDKPIPECAALLCPENSRCSPSTEDENKLECKCLPNYRGDGKYCDPINPCLRKICHPHAHCTYLGPNRHSCTCQEGYRGDGQVCLPVDPCQINFGNCPTKSTVCKYDGPGQSHCECKEHYQNFVPGVGCSMTDICKSDNPCHRNANCTTVAPGRTECICQKGYVGDGLTCYGNIMERLRELNTEPRGKWQGRLTSFISLLDKAYAWPLSKLGPFTVLLPTDKGLKGFNVNELLVDNKAAQYFVKLHIIAGQMNIEYMNNTDMFYTLTGKSGEIFNSDKDNQIKLKLHGGKKKVKIIQGDIIASNGLLHILDRAMDKLEHTFESNNEQTIMTMLQPRYSKFRSLLEETNLGHALDEDGVGGPYTIFVPNNEALNNMKDGTLDYLLSPEGSRKLLELVRYHIVPFTQLEVATLISTPHIRSMANQLIQFNTTDNGQILANDVAMEEIEITAKNGRIYTLTGVLIPPSIVPILPHRCDETKREMKLGTCVSCSLVYWSRCPANSEPTALFTHRCVYSGRFGSLKSGCARYCNATVKIPKCCKGFYGPDCNQCPGGFSNPCSGNGQCADSLGGNGTCICEEGFQGSQCQFCSDPNKYGPRCNKKCLCVHGTCNNRIDSDGACLTGTCRDGSAGRLCDKQTSACGPYVQFCHIHATCEYSNGTASCICKAGYEGDGTLCSEMDPCTGLTPGGCSRNAECIKTGTGTHTCVCQQGWTGNGRDCSEINNCLLPSAGGCHDNASCLYVGPGQNECECKKGFRGNGIDCEPITSCLEQTGKCHPLASCQSTSSGVWSCVCQEGYEGDGFLCYGNAAVELSFLSEAAIFNRWINNASLQPTLSATSNLTVLVPSQQATEDMDQDEKSFWLSQSNIPALIKYHMLLGTYRVADLQTLSSSDMLATSLQGNFLHLAKVDGNITIEGASIVDGDNAATNGVIHIINKVLVPQRRLTGSLPNLLMRLEQMPDYPIFRGYIIQYNLANAIEAADAYTVFAPNNNAIENYIREKKVLSLEEDVLRYHVVLEEKLLKNDLHNGMHRETMLGFSYFLSFFLHNDQLYVNEAPINYTNVATDKGVIHGLGKVLEIQKNRCDNNATTIIRGRCRTCSSELTCPFGTKSLGNEKRRCIYTSYFMGRRTLFIGCQPKCVRTVITRECCAGFFGPQCQPCPGNAQNVCFGNGICLDGVNGTGVCECGEGFSGTACETCTEGKYGIHCDQACSCVHGRCNQGPLGDGSCDCDVGWRGVHCDNATTEDNCNGTCHTSANCLTNSDGTASCKCAAGFQGNGTICTAINACEISNGGCSAKADCKRTTPGRRVCTCKAGYTGDGIVCLEINPCLENHGGCDKNAECTQTGPNQAACNCLPAYTGDGKVCTLINVCLTKNGGCSEFAICNHTGQVERTCTCKPNYIGDGFTCRGSIYQELPKNPKTSQYFFQLQEHFVKDLVGPGPFTVFAPLSAAFDEEARVKDWDKYGLMPQVLRYHVVACHQLLLENLKLISNATSLQGEPIVISVSQSTVYINNKAKIISSDIISTNGIVHIIDKLLSPKNLLITPKDNSGRILQNLTTLATNNGYIKFSNLIQDSGLLSVITDPIHTPVTLFWPTDQALHALPAEQQDFLFNQDNKDKLKEYLKFHVIRDAKVLAVDLPTSTAWKTLQGSELSVKCGAGRDIGDLFLNGQTCRIVQRELLFDLGVAYGIDCLLIDPTLGGRCDTFTTFDASGECGSCVNTPSCPRWSKPKGVKQKCLYNLPFKRNLEGCRERCSLVIQIPRCCKGYFGRDCQACPGGPDAPCNNRGVCLDQYSATGECKCNTGFNGTACEMCWPGRFGPDCLPCGCSDHGQCDDGITGSGQCLCETGWTGPSCDTQAVLPAVCTPPCSAHATCKENNTCECNLDYEGDGITCTVVDFCKQDNGGCAKVARCSQKGTKVSCSCQKGYKGDGHSCTEIDPCADGLNGGCHEHATCKMTGPGKHKCECKSHYVGDGLNCEPEQLPIDRCLQDNGQCHADAKCVDLHFQDTTVGVFHLRSPLGQYKLTFDKAREACANEAATMATYNQLSYAQKAKYHLCSAGWLETGRVAYPTAFASQNCGSGVVGIVDYGPRPNKSEMWDVFCYRMKDVNCTCKVGYVGDGFSCSGNLLQVLMSFPSLTNFLTEVLAYSNSSARGRAFLEHLTDLSIRGTLFVPQNSGLGENETLSGRDIEHHLANVSMFFYNDLVNGTTLQTRLGSKLLITASQDPLQPTETRFVDGRAILQWDIFASNGIIHVISRPLKAPPAPVTLTHTGLGAGIFFAIILVTGAVALAAYSYFRINRRTIGFQHFESEEDINVAALGKQQPENISNPLYESTTSAPPEPSYDPFTDSEERQLEGNDPLRTL

SEQ ID NO: 602 - protein, 713 aa, Homo sapiens
MDELAGGGGGGPGMAAPPRQQQGPGGNLGLSPGGNGAAGGGGPPASEGAGPAAGPELSRPQQNTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 603 - protein, 348 aa, Homo sapiens
MGARGAPSRRRQAGRRLRYLPTGSFPFLLLLLLLCIQLGGGQKKKENLLAEKVEQLMEWSSRRSIFRMNGDKFRKFIKAPPRNYSMIVMFTALQPQRQCSVCRQANEEYQILANSWRYSSAFCNKLFFSMVDYDEGTDVFQQLNMNSAPTFMHFPPKGRPKRADTFDLQRIGFAAEQLAKWIADRTDVHIRVFRPPNYSGTIALALLVSLVGGLLYLRRNNLEFIYNKTGWAMVSLCIVFAMTSGQMWNHIRGPPYAHKNPHNGQVSYIHGSSQAQFVAESHIILVLNAAITMGMVLLNEAATSKGDVGKRRIICLVGLGLVVFFFSFLLSIFRSKYHGYPYSDLDFE

SEQ ID NO: 604 - protein, 290 aa, Homo sapiens
MDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLKNIFKISLGRNLVPKPGDGSLTI

SEQ ID NO: 605 - protein, 317 aa, Homo sapiens
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGGDNGEEGEEESVTGANAEGTTETGGQGKGTSKTTTSPNGGFEPTTPPQVYRTTSPPFGKTTTVEYEGEYEYTGVNEYDNGYEIYESENGEPRGDNYRAYEDEYSYFKGQGYDGYDGQNYYHHQ

SEQ ID NO: 606 - protein, 194 aa, Homo sapiens
MSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 607 - protein, 2480 aa, Homo sapiens
  MOD_RES (1789)..(1789): Variable amino acid
MNSTPRNAQAPSHRECFLPSVARTPSVTKVTPAKKITFLKRGDPRFAGVRLAVHQRAFKTFSALMDELSQRVPLSFGVRSVTTPRGLHSLSALEQLEDGGCYLCSDKKPPKTPSGPGRPQERNPTAQQLRDVEGQREAPGTSSSRKSLKTPRRILLIKNMDPRLQQTVVLSHRNTRNLAAFLGKASDLLRFPVKQLYTTSGKKVDSLQALLHSPSVLVCAGHEAFRTPAMKNARRSEAETLSGLTSRNKNGSWGPKTKPSVIHSRSPPGSTPRLPERPGPSNPPVGPAPGRHPQDTPAQSGPLVAGDDMKKKVRMNEDGSLSVEMKVRFHLVGEDTLLWSRRMGRASALTAASGEDPVLGEVDPLCCVWEGYPWGFSEPGVWGPRPCRVGCREVFGRGGQPGPKYEIWTNPLHASQGERVAARKRWGLAQHVRCSGLWGHGTAGRERCSQDSASPASSTGLPEGSEPESSCCPRTPEDGVDSASPSAQIGAERKAGGSLGEDPGLCIDGAGLGGPEQGGRLTPRARSEEGASSDSSASTGSHEGSSEWGGRPQGCPGKARAETSQQEASEGGDPASPALSLSSLRSDDLQAETQGQGTEQATGAAVTREPLVLGLSCSWDSEGASSTPSTCTSSQQGQRRHRSRASAMSSPSSPGLGRVAPRGHPRHSHYRKDTHSPLDSSVTKQVPRPPERRRACQDGSVPRYSGSSSSTRTQASGNLRPPSSGSLPSQDLLGTSSATVTPAVHSDFVSGVSPHNAPSAGWAGDAGSRTCSPAPIPPHTSDSCSKSGAASPGEEARDTPQPSSPLVLQVGRPEQGAVGPHRSHCCSQPGTQPAQEAQRGPSPEASWLCGRYCPTPPRGRPCPQRRSSSCGSTGSSHQSTARGPGGSPQEGTRQPGPTPSPGPNSGASRRSSASQGAGSRGLSEEKTLRSGGGPQGQEEASGVSPSSLPRSSPEAVVREWLDNIPEEPILMTYELADETTGAAGGGLRGPEVDPGDDHSLEGLGEPAQAGQQSLEGDPGQDPEPEGALLGSSDTGPQSGEGVPQGAAPEGVSEAPAEAGADREAPAGCRVSLRALPGRVSASTQIMRALMGSKQGRPSSVPEVSRPMARRLSCSAGALITCLASLQLFEEDLGSPASKVRFKDSPWYQELLSISKDLWPGCDVGEDQLDSGLWELTWSQALPDLGSHAMTENFTPTSSSGVDISSGSGGSGESSVPCAMDGTLVTQGTELPLKTSNQRPDSRTYESPGDLENQQQCCFPTFLNARACACATNEDEAERDSEEQRASSNLEQLAENTVQEEVQLEETKEGTEGEGLQEEGVQLEETKTEEGLQEEGVQLEETKTEEGLQEEGVQLEETKTEEGLQEEGVQLEETKTEEGLQEEGVQLEETKTEEGLQEEGVQLEETKTEEGLQEEGVQLEGTKETEGEGQQEEEAQLEEIEETGGEGLQEEGVQLEEVKEGPEGGLQGEALEEGLKEEGLPEEGSVHGQELSEASSPDGKGSQEDDPVQEEEAGRASASAEPCPAEGTEEPTEPPSHLSETDPSASESQSGSQLEPGLEKPPGATMMGQEHTQAQPTQGAAERSSSVACSAALDCDPIWVSVLLKKTEKAFLAHLASAVAELRARWGLQDNDLLDQMAAELQQDVAQRLQDSTKRELQKLQGRAGRMVLEPPREALTGELLLQTQQRRHRLRGLRNLSAFSERTLGLGPLSFTLEDEPALSTALGSQLGEEAEGEEFCPCEACVRKKVSPMSPKATMGATRGPIKEAFDLQQILQRKRGEHTDGEAAEVXPGKTHTDPTSTRTVQGAEGGLGPGLSQGPGVDEGEDGEGSQRLNRDKDPKLGEAEGDAMAQEREGKTHNSETSAGSELGEAEQEGEGISERGETGGQGSGHEDNLQGEAAAGGDQDPGQSDGAEGIEAPEAEGEAQPESEGVEAPEAEGDAQEAEGEAQPESEDVEAPEAEGEAQPESEDVETPEAEWEVQPESEGAEAPEAEKEAQPETESVEALETEGEDEPESEGAEAQEAEEEAQEAEGQAQPESEVIESQEAEEEAQPESEDVEALEVEVETQEAEGEAQPESEDVEAPEAEGEMQEAEEEAQPESDGVEAQPKSEGEEAQEVEGETQKTEGDAQPESDGVEAPEAEEEAQEAEGEVQEAEGEAHPESEDVDAQEAEGEAQPESEGVEAPEAEGEAQKAEGIEAPETEGEAQPESEGIEAPEAEGEAQPESEGVEAQDAEGEAQPESEGIEAQEAEKEAQPELEGVEAPEAEGEAQPESEGIEAPEAEGEAQPELEGVEAPEAEEEAQPEPEGVETPEAEGEAQPESGGETQGEKKGSPQVSLGDGQSEEASESSSPVPEDRPTPPPSPGGDTPHQRPGSQTGPSSSRASSWGNCWQKDSENDHVLGDTRSPDAKSTGTPHAERKATRMYPESSTSEQEEAPLGSRTPEQGASEGYDLQEDQALGSLAPTEAVGRADGFGQDDLDF

SEQ ID NO: 608 - protein, 328 aa, Homo sapiens
MSMLAERRRKQKWAVDPQNTAWSNDDSKFGQRMLEKMGWSKGKGLGAQEQGATDHIKVQVKNNHLGLGATINNEDNWIAHQDDFNQLLAELNTCHGQETTDSSDKKEKKSFSLEEKSKISKNRVHYMKFTKGKDLSSRSKTDLDCIFGKRQSKKTPEGDASPSTPEENETTTTSAFTIQEYFAKRMAALKNKPQVPVPGSDISVTQVERKRGKKRNKEATGKDVESYLQPKAKRHTEGKPERAEAQERVAKKKSAPAEEQLRGPCWDQSSKASAQDAGDHVQPPEGRDFTLKPKKRRGKKKLQKPVEIAEDATLEETLVKKKKKKDSK

SEQ ID NO: 609 - protein, 526 aa, Homo sapiens
MGGRSSCEDPGCPRDEERAPRMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAWEIPRESLKLEKKLGAGQFGEVWMATYNKHTKVAVKTMKPGSMSVEAFLAEANVMKTLQHDKLVKLHAVVTKEPIYIITEFMAKGSLLDFLKSDEGSKQPLPKLIDFSAQIAEGMAFIEQRNYIHRDLRAANILVSASLVCKIADFGLARVIEDNEYTAREGAKFPIKWTAPEAINFGSFTIKSDVWSFGILLMEIVTYGRIPYPGMSNPEVIRALERGYRMPRPENCPEELYNIMMRCWKNRPEERPTFEYIQSVLDDFYTATESQYQQQP

SEQ ID NO: 610 - protein, 784 aa, Homo sapiens
MEGEMAVRVTAAHTAEAQAEAGREAGEGAVAAVAAALAPSGFLGLPAPFSEEDEDDVHRCGRCQAEFTALEDFVQHKIQKACQRAPPEALPATPATTALLGQEVVPAAPGPEEPITVAHIVVEAASLAADISHASDLVGGGHIKEVIVAAEAELGDGEMAEAPGSPHQQGLGLAGEGEQAQVKLLVNKDGRYVCALCHKTFKTGSILKAHMVTHSSRKDHECKLCGASFRTKGSLIRHHRRHTDERPYKCSKCGKSFRESGALTRHLKSLTPCTEKIRFSVSKDVVVSKEDARAGSGAGAAGLGTATSSVTGEPIETSPVIHLVTDAKGTVIHEVHVQMQELSLGMKALAPEPPVSQELPCSRKGSRENLLHQAMQNSGIVLERAAGEEGALEPAPAAGSSPQPLAVAAPQLPVLEVQPLETQVASEASAVPRTHPCPQCSETFPTAATLEAHKRGHTGPRPFACAQCGKAFPKAYLLKTDQEVHVRERRFRCGDCGKLYKTIAHVRGHRRVHSDERPYPCPKCGKRYKTKNAQQVHFRTHLEEKPHVCQFCSRGFREKGSLVRHVRHHTGEKPFKCYKCGRGFAEHGTLNRHLRTKGGCLLEVEELLVSEDSPAAATTVLTEDPHTVLVEFSSVVADTQEYIIEATADDAETSEATEIIEGTQTEVDSHIMKVVQQIVHPRSAGHQIIVQNVTMDEETALGPRGAAADTITIATPESLTEQVAMTLASAISEGTVLAARAGTSGTEQATVTMVSSEDIEILEHAGELVIASPEGQLEVQTVIV

SEQ ID NO: 611 - protein, 823 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGKDEPSSYICTTCKQPFNSAWFLLQHAQNTHGFRIYLEPGPASSSLTPRLTIPPPLGPEAVAQSPLMNFLGDSNPFNLLRMTGPILRDHPGFGEGRLPGTPPLFSPPPRHHLDPHRLSAEEMGLVAQHPSAFDRVMRLNPMAIDSPAMDFSRRLRELAGNSSTPPPVSPGRGNPMHRLLNPFQPSPKSPFLSTPPLPPMPPGGTPPPQPPAKSKSCEFCGKTFKFQSNLIVHRRSHTGEKPYKCQLCDHACSQASKLKRHMKTHMHKAGSLAGRSDDGLSAASSPEPGTSELAGEGLKAADGDFRHHESDPSLGHEPEEEDEEEEEEEEELLLENESRPESSFSMDSELSRNRENGGGGVPGVPGAGGGAAKALADEKALVLGKVMENVGLGALPQYGELLADKQKRGAFLKRAAGGGDAGDDDDAGGCGDAGAGGAVNGRGGGFAPGTEPFPGLFPRKPAPLPSPGLNSAAKRIKVEKDLELPPAALIPSENVYSQWLVGYAASRHFMKDPFLGFTDARQSPFATSSEHSSENGSLRFSTPPGDLLDGGLSGRSGTASGGSTPHLGGPGPGRPSSKEGRRSDTCEYCGKVFKNCSNLTVHRRSHTGERPYKCELCNYACAQSSKLTRHMKTHGQIGKEVYRCDICQMPFSVYSTLEKHMKKWHGEHLLTNDVKIEQAERS

SEQ ID NO: 612 - protein, 331 aa, Homo sapiens
MEVTGDAGVPESGEIRTLKPCLLRRNYSREQHGVAASCLEDLRSKACDILAIDKSLTPVTLVLAEDGTIVDDDDYFLCLPSNTKFVALASNEKWAYNNSDGGTAWISQESFDVDETDSGAGLKWKNVARQLKEDLSSIILLSEEDLQMLVDAPCSDLAQELRQSCATVQRLQHTLQQVLDQREEVRQSKQLLQLYLQALEKEGSLLSKQEESKAAFGEEVDAVDTGISRETSSDVALASHILTALREKQAPELSLSSQDLELVTKEDPKALAVALNWDIKKTETVQEACERELALRLQQTQSLHSLRSISASKASPPGDLQNPKRARQDPT

SEQ ID NO: 613 - protein, 501 aa, Homo sapiens
MQARYSVSDPNALGVVPYLSEQNYYRAAGSYGGMASPMGVYSGHPEQYSAGMGRSYAPYHHHQPAAPKDLVKPPYSYIALITMAIQNAPEKKITLNGIYQFIMDRFPFYRENKQGWQNSIRHNLSLNECFVKVPRDDKKPGKGSYWTLDPDSYNMFENGSFLRRRRRFKKKDVSKEKEERAHLKEPPPAASKGAPATPHLADAPKEAEKKVVIKSEAASPALPVITKVETLSPESALQGSPRSAASTPAGSPDGSLPEHHAAAPNGLPGFSVENIMTLRTSPPGGELSPGAGRAGLVVPPLALPYAAAPPAAYGQPCAQGLEAGAAGGYQCSMRAMSLYTGAERPAHMCVPPALDEALSDHPSGPTSPLSALNLAAGQEGALAATGHHHQHHGHHHPQAPPPPPAPQPQPTPQPGAAAAQAASWYLNHSGDLNHLPGHTFAAQQQTFPNVREMFNSHRLGIENSTLGESQVSGNASCQLPYRSTPPLYRHAAPYSYDCTKY

SEQ ID NO: 614 - protein, 250 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 615 - protein, 166 aa, Homo sapiens
MEATTAGVGRLEEEALRRKERLKALREKTGRKDKEDGEPKTKHLREEEEEGEKHRELRLRNYVPEDEDLKKRRVPQAKPVAVEEKVKEQLEAAKPEPVIEEVDLANLAPRKPDWDLKRDVAKKLEKLKKRTQRAIAELIRERLKGQEDSLASAVDAATEQKTCDSD

SEQ ID NO: 616 - protein, 664 aa, Homo sapiens
MKTGPFFLCLLGTAAAIPTNARLLSDHSKPTAETVAPDNTAIPSLWAEAEENEKETAVSTEDDSHHKAEKSSVLKSKEESHEQSAEQGKSSSQELGLKDQEDSDGHLSVNLEYAPTEGTLDIKEDMIEPQEKKLSENTDFLAPGVSSFTDSNQQESITKREENQEQPRNYSHHQLNRSSKHSQGLRDQGNQEQDPNISNGEEEEEKEPGEVGTHNDNQERKTELPREHANSKQEEDNTQSDDILEESDQPTQVSKMQEDEFDQGNQEQEDNSNAEMEEENASNVNKHIQETEWQSQEGKTGLEAISNHKETEEKTVSEALLMEPTDDGNTTPRNHGVDDDGDDDGDDGGTDGPRHSASDDYFIPSQAFLEAERAQSIAYHLKIEEQREKVHENENIGTTEPGEHQEAKKAENSSNEEETSSEGNMRVHAVDSCMSFQCKRGHICKADQQGKPHCVCQDPVTCPPTKPLDQVCGTDNQTYASSCHLFATKCRLEGTKKGHQLQLDYFGACKSIPTCTDFEVIQFPLRMRDWLKNILMQLYEANSEHAGYLNEKQRNKVKKIYLDEKRLLAGDHPIDLLLRDFKKNYHMYVYPVHWQFSELDQHPMDRVLTHSELAPLRASLVPMEHCITRFFEECDPNKDKHITLKEWGHCFGIKEEDIDENLLF

SEQ ID NO: 617 - protein, 262 aa, Homo sapiens
MDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 618 - protein, 329 aa, Homo sapiens
MVSKSRWKLLAMLALVLVVMVWYSISREDSFYFPIPEKKEPCLQGEAESKASKLFGNYSRDQPIFLRLEDYFWVKTPSAYELPYGTKGSEDLLLRVLAITSSSIPKNIQSLRCRRCVVVGNGHRLRNSSLGDAINKYDVVIRLNNAPVAGYEGDVGSKTTMRLFYPESAHFDPKVENNPDTLLVLVAFKAMDFHWIETILSDKKRVRKGFWKQPPLIWDVNPKQIRILNPFFMEIAADKLLSLPMQQPRKIKQKPTTGLLAITLALHLCDLVHIAGFGYPDAYNKKQTIHYYEQITLKSMAGSGHNVSQEALAIKRMLEMGAIKNLTSF

SEQ ID NO: 619 - protein, 131 aa, Homo sapiens
MEMGKWIHLELRNRTPSDVKELFLDNSQSNEGKLEGLTDEFEELELLNTINIGLTSIANLPKLNKLKKLELSSNRASVGLEVLAEKCPNLIHLNLSGNKIKDLSTIEPLKKLENLESLDLFTCEVTNLNNY

SEQ ID NO: 620 - protein, 299 aa, Homo sapiens
MASRLLHRHIREQLKDLKEVSHESLVVGAIENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 621 - protein, 219 aa, Homo sapiens
MSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 622 - protein, 670 aa, Homo sapiens
MSSGKSARYNRFSGGPSNLPTPDVTTGTRMETTFGPAFSAVTTITKADGTSTYKQHCRTPSSSSTLAYSPRDEEDSMPPISTPRRSDSAISVRSLHSESSMSLRSTFSLPEEEEEPEPLVFAEQPSVKLCCQLCCSVFKDPVITTCGHTFCRRCALKSEKCPVDNVKLTVVVNNIAVAEQIGELFIHCRHGCRVAGSGKPPIFEVDPRGCPFTIKLSARKDHEGSCDYRPVRCPNNPSCPPLLRMNLEAHLKECEHIKCPHSKYGCTFIGNQDTYETHLETCRFEGLKEFLQQTDDRFHEMHVALAQKDQEIAFLRSMLGKLSEKIDQLEKSLELKFDVLDENQSKLSEDLMEFRRDASMLNDELSHINARLNMGILGSYDPQQIFKCKGTFVGHQGPVWCLCVYSMGDLLFSGSSDKTIKVWDTCTTYKCQKTLEGHDGIVLALCIQGCKLYSGSADCTIIVWDIQNLQKVNTIRAHDNPVCTLVSSHNVLFSGSLKAIKVWDIVGTELKLKKELTGLNHWVRALVAAQSYLYSGSYQTIKIWDIRTLDCIHVLQTSGGSVYSIAVTNHHIVCGTYENLIHVWDIESKEQVRTLTGHVGTVYALAVISTPDQTKVFSASYDRSLRVWSMDNMICTQTLLRHQGSVTALAVSRGRLFSGAVDSTVKVWTC

SEQ ID NO: 623 - protein, 2612 aa, Homo sapiens
MADVDPDTLLEWLQMGQGDERDMQLIALEQLCMLLLMSDNVDRCFETCPPRTFLPALCKIFLDESAPDNVLEVTARAITYYLDVSAECTRRIVGVDGAIKALCNRLVVVELNNRTSRDLAEQCVKVLELICTRESGAVFEAGGLNCVLTFIRDSGHLVHKDTLHSAMAVVSRLCGKMEPQDSSLEICVESLSSLLKHEDHQVSDGALRCFASLADRFTRRGVDPAPLAKHGLTEELLSRMAAAGGTVSGPSSACKPGRSTTGAPSTTADSKLSNQVSTIVSLLSTLCRGSPVVTHDLLRSELPDSIESALQGDERCVLDTMRLVDLLLVLLFEGRKALPKSSAGSTGRIPGLRRLDSSGERSHRQLIDCIRSKDTDALIDAIDTGAFEVNFMDDVGQTLLNWASAFGTQEMVEFLCERGADVNRGQRSSSLHYAACFGRPQVAKTLLRHGANPDLRDEDGKTPLDKARERGHSEVVAILQSPGDWMCPVNKGDDKKKKDTNKDEEECNEPKGDPEMAPIYLKRLLPVFAQTFQQTMLPSIRKASLALIRKMIHFCSEALLQEVCDSDVGHNLPTILVEITATVLDQEDDDDGHLLALQIIRDIVDKGGDIYKHQLARLGVISKVSTLAGPSSDDENEEESKPEKEDEPQEDAQELQQGKPYHWRDWSIIRGRDCLYIWSDAAALELSNGSNGWFRFILDGKLATMYSSGSPEGGSDSSESRSEFLEKLQRARGQVKPSTSSQPILSAPGPTKLTVGNWSLTCLKEGEIAIHNSDGQQATILKEDLPGFVFESNRGTKHSFTAETSLGSEFVTGWTGKRGRKLKSKLEKTKQKVRTMARDLYDDHFKAVESMPRGVVVTLRNIATQLESSWELHTNRQCIESENTWRDLMKTALKNLIVLLKDENTISPYEMCSSGLVQALLTVLNNVSIFRATKQKQNEVPKVILSVFKTAFTENEDDESRPAVALIRKLIAVLESIERLPLHLYDTPGSTYNLQILTRRLRFRLERAPGETALIDRTGRMLKMEPLATVESLEQYLLKMVAKQWYDFDRSSFVFVRKLREGQNFIFRHQHDFDENGIIYWIGTNAKTAYEWVNPAAYGLVVVTSSEGRNLPYGRLEDILSRDNSALNCHSNDDKNAWFAIDLGLWVIPSAYTLRHARGYGRSALRNWVFQVSKDGQNWTSLYTHVDDCSLNEPGSTATWPLDPPKDEKQGWRHVRIKQMGKNASGQTHYLSLSGFELYGTVNGVCEDQLGKAAKEAEANLRRQRRLVRSQVLKYMVPGARVIRGLDWKWRDQDGSPQGEGTVTGELHNGWIDVTWDAGGSNSYRMGAEGKFDLKLAPGYDPDTVASPKPVSSTVSGTTQSWSSLVKNNCPDKTSAAAGSSSRKGSSSSVCSVASSSDISLGSTKTERRSEIVMEHSIVSGADVHEPIVVLSSAENVPQTEVGSSSSASTSTLTAETGSENAERKLGPDSSVRTPGESSAISMGIVSVSSPDVSSVSELTNKEAASQRPLSSSASNRLSVSSLLAAGAPMSSSASVPNLSSRETSSLESFVRRVANIARTNATNNMNLSRSSSDNNTNTLGRNVMSTATSPLMGAQSFPNLTTPGTTSTVTMSTSSVTSSSNVATATTVLSVGQSLSNTLTTSLTSTSSESDTGQEAEYSLYDFLDSCRASTLLAELDDDEDLPEPDEEDDENEDDNQEDQEYEEVMILRRPSLQRRAGSRSDVTHHAVTSQLPQVPAGAGSRPIGEQEEEEYETKGGRRRTWDDDYVLKRQFSALVPAFDPRPGRTNVQQTTDLEIPPPGTPHSELLEEVECTPSPRLALTLKVTGLGTTREVELPLTNFRSTIFYYVQKLLQLSCNGNVKSDKLRRIWEPTYTIMYREMKDSDKEKENGKMGCWSIEHVEQYLGTDELPKNDLITYLQKNADAAFLRHWKLTGTNKSIRKNRNCSQLIAAYKDFCEHGTKSGLNQGAISTLQSSDILNLTKEQPQAKAGNGQNSCGVEDVLQLLRILYIVASDPYSRISQEDGDEQLQFTFPPDEFTSKKITTKILQQIEEPLALASGALPDWCEQLTSKCPFLIPFETRQLYFTCTAFGASRAIVWLQNRREATVERTRTTSSVRRDDPGEFRVGRLKHERVKVPRGESLMEWAENVMQIHADRKSVLEVEFLGEEGTGLGPTLEFYALVAAEFQRTDLGAWLCDDNFPDDESRHVDLGGGLKPPGYYVQRSCGLFTAPFPQDSDELERITKLFHFLGIFLAKCIQDNRLVDLPISKPFFKLMCMGDIKSNMSKLIYESRGDRDLHCTESQSEASTEEGHDSLSVGSFEEDSKSEFILDPPKPKPPAWFNGILTWEDFELVNPHRARFLKEIKDLAIKRRQILSNKGLSEDEKNTKLQELVLKNPSGSGPPLSIEDLGLNFQFCPSSRIYGFTAVDLKPSGEDEMITMDNAEEYVDLMFDFCMHTGIQKQMEAFRDGFNKVFPMEKLSSFSHEEVQMILCGNQSPSWAAEDIINYTEPKLGYTRDSPGFLRFVRVLCGMSSDERKAFLQFTTGCSTLPPGGLANLHPRLTVVRKVDATDASYPSVNTCVHYLKLPEYSSEEIMRERLLAATMEKGFHLN

SEQ ID NO: 624 - protein, 440 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 625 - protein, 412 aa, Homo sapiens
MANVADTKLYDILGVPPGASENELKKAYRKLAKEYHPDKNPNAGDKFKEISFAYEVLSNPEKRELYDRYGEQGLREGSGGGGGMDDIFSHIFGGGLFGFMGNQSRSRNGRRRGEDMMHPLKVSLEDLYNGKTTKLQLSKNVLCSACSGQGGKSGAVQKCSACRGRGVRIMIRQLAPGMVQQMQSVCSDCNGEGEVINEKDRCKKCEGKKVIKEVKILEVHVDKGMKHGQRITFTGEADQAPGVEPGDIVLLLQEKEHEVFQRDGNDLHMTYKIGLVEALCGFQFTFKHLDGRQIVVKYPPGKVIEPGCVRVVRGEGMPQYRNPFEKGDLYIKFDVQFPENNWINPDKLSELEDLLPSRPEVPNIIGETEEVELQEFDSTRGSGGGQRREAYNDSSDEESSSHHGPGVQCAHQ

SEQ ID NO: 626 - protein, 189 aa, Homo sapiens
MGLGARGAWAALLLGTLQVLALLGAAHESAAMAETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 627 - protein, 470 aa, Homo sapiens
MGKLHSKPAAVCKRRESPEGDSFAVSAAWARKGIEEWIGRQRCPGGVSGPRQLRLAGTIGRSTRELVGDVLRDTLSEEEEDDFRLEVALPPEKTDGLGSGDEKKMERVSEPCPGSKKQLKFEELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 628 - protein, 282 aa, Homo sapiens
MSRQTATALPTGTSKCPPSQRVPALTGTTASNNDLASLFECPVCFDYVLPPILQCQSGHLVCSNCRPKLTCCPTCRGPLGSIRNLAMEKVANSVLFPCKYASSGCEITLPHTEKADHEELCEFRPYSCPCPGASCKWQGSLDAVMPHLMHQHKSITTLQGEDIVFLATDINLSGAVDWVMMQSCFGFHFMLVLEKQEKYDGHQQFFAIVQLIGTRKQAENFAYRLELNGHRRRLTWEATPRSIHGGIATAIMNSDCLVFDTSIAQLFAENGNLGINVTISMC

SEQ ID NO: 629 - protein, 1091 aa, Homo sapiens
MCRKKPDTMILTQIEAKEACDWLRATGFPQYAQLYEDFLFPIDISLVKREHDFLDRDAIEALCRRLNTLNKCAVMKLEISPHRKRSDDSDEDEPCAISGKWTFQRDSKRWSRLEEFDVFSPKQDLVPGSPDDSHPKDGPSPGGTLMDLSERQEVSSVRSLSSTGSLPSHAPPSEDAATPRTNSVISVCSSSNLAGNDDSFGSLPSPKELSSFSFSMKGHEKTAKSKTRSLLKRMESLKLKSSHHSKHKAPSKLGLIISGPILQEGMDEEKLKQLNCVEISALNGNRINVPMVRKRSVSNSTQTSSSSSQSETSSAVSTPSPVTRTRSLSACNKRVGMYLEGFDPFNQSTFNNVVEQNFKNRESYPEDTVFYIPEDHKPGTFPKALTNGSFSPSGNNGSVNWRTGSFHGPGHISLRRENSSDSPKELKRRNSSSSMSSRLSIYDNVPGSILYSSSGDLADLENEDIFPELDDILYHVKGMQRIVNQWSEKFSDEGDSDSALDSVSPCPSSPKQIHLDVDNDRTTPSDLDSTGNSLNEPEEPSEIPERRDSGVGASLTRSNRHRLRWHSFQSSHRPSLNSVSLQINCQSVAQMNLLQKYSLLKLTALLEKYTPSNKHGFSWAVPKFMKRIKVPDYKDRSVFGVPLTVNVQRTGQPLPQSIQQAMRYLRNHCLDQVGLFRKSGVKSRIQALRQMNEGAIDCVNYEGQSAYDVADMLKQYFRDLPEPLMTNKLSETFLQIYQYVPKDQRLQAIKAAIMLLPDENREVLQTLLYFLSDVTAAVKENQMTPTNLAVCLAPSLFHLNTLKRENSSPRVMQRKQSLGKPDQKDLNENLAATQGLAHMIAECKKLFQVPEEMSRCRNSYTEQELKPLTLEALGHLGNDDSADYQHFLQDCVDGLFKEVKEKFKGWVSYSTSEQAELSYKKVSEGPPLRLWRSVIEVPAVPEEILKRLLKEQHLWDVDLLDSKVIEILDSQTEIYQYVQNSMAPHPARDYVVLRTWRTNLPKGACALLLTSVDHDRAPVVGVRVNVLLSRYLIEPCGPGKSKLTYMCRVDLRGHMPEWYTKSFGHLCAAEVVKIRDSFSNQNTETKDTKSR

SEQ ID NO: 630 - protein, 2061 aa, Homo sapiens
MERRGKYSSKLERESKRTSENEAIKRCCSPPNELGFRRGSSYSKHDSSASRYKSTLSKPIPKSDKFKNSFCCTELNEEIKQSHSFSLQTPCSKGSELRMINKNPEREKAGSPAPSNRLNDSPTLKKLDELPIFKSEFITHDSHDSIKELDSLSKVKNDQLRSFCPIELNINGSPGAESDLATFCTSKTDAVLMTSDDSVTGSELSPLVKACMLSSNGFQNISRCKEKDLDDTCMLHKKSESPFRETEPLVSPHQDKLMSMPVMTVDYSKTVVKEPVDTRVSCCKTKDSDIYCTLNDSNPSLCNSEAENIEPSVMKISSNSFMNVHLESKPVICDSRNLTDHSKFACEEYKQSIGSTSSASVNHFDDLYQPIGSSGIASSLQSLPPGIKVDSLTLLKCGENTSPVLDAVLKSKKSSEFLKHAGKETIVEVGSDLPDSGKGFASRENRRNNGLSGKCLQEAQEEGNSILPERRGRPEISLDERGEGGHVHTSDDSEVVFSSCDLNLTMEDSDGVTYALKCDSSGHAPEIVSTVHEDYSGSSESSNDESDSEDTDSDDSSIPRNRLQSVVVVPKNSTLPMEETSPCSSRSSQSYRHYSDHWEDERLESRRHLYEEKFESIASKACPQTDKFFLHKGTEKNPEISFTQSSRKQIDNRLPELSHPQSDGVDSTSHTDVKSDPLGHPNSEETVKAKIPSRQQEELPIYSSDFEDVPNKSWQQTTFQNRPDSRLGKTELSFSSSCEIPHVDGLHSSEELRNLGWDFSQEKPSTTYQQPDSSYGACGGHKYQQNAEQYGGTRDYWQGNGYWDPRSGRPPGTGVVYDRTQGQVPDSLTDDREEEENWDQQDGSHFSDQSDKFLLSLQKDKGSVQAPEISSNSIKDTLAVNEKKDFSKNLEKNDIKDRGPLKKRRQEIESDSESDGELQDRKKVRVEVEQGETSVPPGSALVGPSCVMDDFRDPQRWKECAKQGKMPCYFDLIEENVYLTERKKNKSHRDIKRMQCECTPLSKDERAQGEIACGEDCLNRLLMIECSSRCPNGDYCSNRRFQRKQHADVEVILTEKKGWGLRAAKDLPSNTFVLEYCGEVLDHKEFKARVKEYARNKNIHYYFMALKNDEIIDATQKGNCSRFMNHSCEPNCETQKWTVNGQLRVGFFTTKLVPSGSELTFDYQFQRYGKEAQKCFCGSANCRGYLGGENRVSIRAAGGKMKKERSRKKDSVDGELEALMENGEGLSDKNQVLSLSRLMVRIETLEQKLTCLELIQNTHSQSCLKSFLERHGLSLLWIWMAELGDGRESNQKLQEEIIKTLEHLPIPTKNMLEESKVLPIIQRWSQTKTAVPPLSEGDGYSSENTSRAHTPLNTPDPSTKLSTEADTDTPKKLMFRRLKIISENSMDSAISDATSELEGKDGKEDLDQLENVPVEEEEELQSQQLLPQQLPECKVDSETNIEASKLPTSEPEADAEIEPKESNGTKLEEPINEETPSQDEEEGVSDVESERSQEQPDKTVDISDLATKLLDSWKDLKEVYRIPKKSQTEKENTTTERGRDAVGFRDQTPAPKTPNRSRERDPDKQTQNKEKRKRRSSLSPPSSAYERGTKRPDDRYDTPTSKKKVRIKDRNKLSTEERRKLFEQEVAQREAQKQQQQMQNLGMTSPLPYDSLGYNAPHHPFAGYPPGYPMQAYVDPSNPNAGKVLLPTPSMDPVCSPAPYDHAQPLVGHSTEPLSAPPPVPVVPHVAAPVEVSSSQYVAQSDGVVHQDSSVAVLPVPAPGPVQGQNYSVWDSNQQSVSVQQQYSPAQSQATIYYQGQTCPTVYGVTSPYSQTTPPIVQSYAQPSLQYIQGQQIFTAHPQGVVVQPAAAVTTIVAPGQPQPLQPSEMVVTNNLLDLPPPSPPKPKTIVLPPNWKTARDPEGKIYYYHVITRQTQWDPPTWESPGDDASLEHEAEMDLGTPTYDENPMKASKKPKTAEADTSSELAKKSKEVFRKEMSQFIVQCLNPYRKPDCKVGRITTTEDFKHLARKLTHGVMNKELKYCKNPEDLECNENVKHKTKEYIKKYMQKFGAVYKPKEDTELE

SEQ ID NO: 631 - protein, 310 aa, Homo sapiens
MQQNNSVPEFILLGLTQDPLRQKIVFVIFLIFYMGTVVGNMLIIVTIKSSRTLGSPMYFFLFYLSFADSCFSTSTAPRLIVDALSEKKIITYNECMTQVFALHLFGCMEIFVLILMAVDRYVAICKPLRYPTIMSQQVCIILIVLAWIGSLIHSTAQIILALRLPFCGPYLIDHYCCDLQPLLKLACMDTYMINLLLVSNSGAICSSSFMILIISYIVILHSLRNHSAKGKKKALSACTSHIIVVILFFGPCIFIYTRPPTTFPMDKMVAVFYTIGTPFLNPLIYTLRNAEVKNAMRKLWHGKIISENKG

SEQ ID NO: 632 - protein, 272 aa, Homo sapiens
MSESEQALKGTSQIKLLSSEDIEGMRLVCRLAREVLDVAAGMIKPGVTTEEIDHAVHLACIARNCYPSPLNYYNFPKSCCTSVNEVICHGIPDRRPLQEGDIVNVDITLYRNGYHGDLNETFFVGEVDDGARKLVQTTYECLMQAIDAVKPGVRYRELGNIIQKHAQANGFSVVRSYCGHGIHKLFHTAPNVPHYAKNKAVGVMKSGHVFTIEPMICEGGWQDETWPDGWTAVTRDGKRSAQFEHTLLVTDTGCEILTRRLDSARPHFMSQF

SEQ ID NO: 633 - protein, 558 aa, Homo sapiens
MYFFLNYLSLSDLCYTSTVTPKLMVDLLAERKTISYNNCMIQLFTTHFFGGIEIFILTGMAYDRYVAICKPLHYTIIMSRQKCNTIIIVCCTGGFIHSASQFLLTIFVPFCGPNEIDHYFCDVYPLLKLACSNIHMIGLLVIANSGLIALVTFVVLLLSYVFILYTIRAYSAERRSKALATCSSHVIVVVLFFAPALFIYIRPVTTFSEDKVFALFYTIIAPMFNPLIYTLRNTEMKNAMRKNLTHSMEKINNVTEFIFWGLSQSPEIEKVCFVVFSFFYIIILLGNLLIMLTVCLSNLFKSPMYFFLSFLSFVDICYSSVTAPKMIVDLLAKDKTISYVGCMLQLFGVHFFGCTEIFILTVMAYDRYVAICKPLHYMTIMNRETCNKMLLGTWVGGFLHSIIQVALVVQLPFCGPNEIDHYFCDVHPVLKLACTETYIVGVVVTANSGTIALGSFVILLISYSIILVSLRKQSAEGRRKALSTCGSHIAMVVIFFGPCTFMYMRPDTTFSEDKMVAVFYTIITPMLNPLIYTLRNAEVKNAMKKLWGRNVFLEAKGK

SEQ ID NO: 634 - protein, 1040 aa, Homo sapiens
MGEEGGSASHDEEERASVLLGHSPGCEMCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLPIFTPSQRARRLLDLATVKANGLAAFLLQHVQELPVPLALPLEAATCKKYMAKLRTTVSAQSRFLSTYDGAETLCLEDIYTENVLEVWADVGMAGPPQKSPATLGLEELFSTPGHLNDDADTVLVVGEAGSGKSTLLQRLHLLWAAGQDFQEFLFVFPFSCRQLQCMAKPLSVRTLLFEHCCWPDVGQEDIFQLLLDHPDRVLLTFDGFDEFKFRFTDRERHCSPTDPTSVQTLLFNLLQGNLLKNARKVVTSRPAAVSAFLRKYIRTEFNLKGFSEQGIELYLRKRHHEPGVADRLIRLLQETSALHGLCHLPVFSWMVSKCHQELLLQEGGSPKTTTDMYLLILQHFLLHATPPDSASQGLGPSLLRGRLPTLLHLGRLALWGLGMCCYVFSAQQLQAAQVSPDDISLGFLVRAKGVVPGSTAPLEFLHITFQCFFAAFYLALSADVPPALLRHLFNCGRPGNSPMARLLPTMCIQASEGKDSSVAALLQKAEPHNLQITAAFLAGLLSREHWGLLAECQTSEKALLRRQACARWCLARSLRKHFHSIPPAAPGEAKSVHAMPGFIWLIRSLYEMQEERLARKAARGLNVGHLKLTFCSVGPTECAALAFVLQHLRRPVALQLDYNSVGDIGVEQLLPCLGVCKALYLRDNNISDRGICKLIECALHCEQLQKLALFNNKLTDGCAHSMAKLLACRQNFLALRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 635 - protein, 235 aa, Homo sapiens
MGNGMTKVLPGLYLGNFIDAKDLDQLGRNKITHIISIHESPQPLLQDITYLRIPVADTPEVPIKKHFKECINFIHCCRLNGGNCLVHCFAGISRSTTIVTAYVMTVTGLGWRDVLEAIKATRPIANPNPGFRQQLEEFGWASSQKLRRQLEERFGESPFRDEEELRALLPLCKRCRQGSATSASSAGPHSAASEGTVQRLVPRTPREAHRPLPLLARVKQTFSCLPRCLSRKGGK

SEQ ID NO: 636 - protein, 471 aa, Homo sapiens
MEGQVVGRVFRLFQRRLLQLRAGPPQDNSGEALKEPERAQEHSLPNFAGGQHFFEYLLVVSLKKKRSEDDYEPIITYQFPKRENLLRGQQEEEERLLKAIPLFCFPDGNEWASLTEYPRETFSFVLTNVDGSRKIGYCRRLLPAGPGPRLPKVYCIISCIGCFGLFSKILDEVEKRHQISMAVIYPFMQGLREAAFPAPGKTVTLKSFIPDSGTEFISLTRPLDSHLEHVDFSSLLHCLSFEQILQIFASAVLERKIIFLAEGLSTLSQCIHAAAALLYPFSWAHTYIPVVPESLLATVCCPTPFMVGVQMRFQQEVMDSPMEEVLLVNLCEGTFLMSVGDEKDILPPKLQDDILDSLGQGINELKTAEQINEHVSGPFVQFFVKIVGHYASYIKREANGQGHFQERSFCKALTSKTNRRFVKKFVKTQLFSLFIQEAEKSKNPPAGYFQQKILEYEEQKKQKKPREKTVK

SEQ ID NO: 637 - protein, 440 aa, Homo sapiens
MEQRGQNAPAASGARKRHGPGPREARGARPGLRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEAPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 638 - protein, 442 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQRDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 639 - protein, 292 aa, Homo sapiens
MNPFWSMSTSSVRKRSEGEEKTLTGDVKTSPPRTAPKKQLPSIPKNALPITKPTSPAPAAQSTNGTHASYGPFYLEYSLLAEFTLVVKQKLPGVYVQPSYRSALMWFGVIFIRHGLYQDGVFKFTVYIPDNYPDGDCPRLVFDIPVFHPLVDPTSGELDVKRAFAKWRRNHNHIWQVLMYARRVFYKIDTASPLNPEAAVLYEKDIQLFKSKVVDSVKVCTARLFDQPKIEDPYAISFSPWNPSVHDEAREKMLTQKKPEEQHNKSVHVAGLSWVKPGSVQPFSKEEKTVAT

SEQ ID NO: 640 - protein, 4302 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRCLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 641 - protein, 956 aa, Homo sapiens
MSSGLWSQEKVTSPYWEERIFYLLLQECSVTDKQTQKLLKVPKGSIGQYIQDRSVGHSRIPSAKGKKNQIGLKILEQPHAVLFVDEKDVVEINEKFTELLLAITNCEERFSLFKNRNRLSKGLQIDVGCPVKVQLRSGEEKFPGVVRFRGPLLAERTVSGIFFGVELLEEGRGQGFTDGVYQGKQLFQCDEDCGVFVALDKLELIEDDDTALESDYAGPGDTMQVELPPLEINSRVSLKVGETIESGTVIFCDVLPGKESLGYFVGVDMDNPIGNWDGRFDGVQLCSFACVESTILLHINDIIPALSESVTQERRPPKLAFMSRGVGDKGSSSHNKPKATGSTSDPGNRNRSELFYTLNGSSVDSQPQSKSKNTWYIDEVAEDPAKSLTEISTDFDRSSPPLQPPPVNSLTTENRFHSLPFSLTKMPNTNGSIGHSPLSLSAQSVMEELNTAPVQESPPLAMPPGNSHGLEVGSLAEVKENPPFYGVIRWIGQPPGLNEVLAGLELEDECAGCTDGTFRGTRYFTCALKKALFVKLKSCRPDSRFASLQPVSNQIERCNSLAFGGYLSEVVEENTPPKMEKEGLEIMIGKKKGIQGHYNSCYLDSTLFCLFAFSSVLDTVLLRPKEKNDVEYYSETQELLRTEIVNPLRIYGYVCATKIMKLRKILEKVEAASGFTSEEKDPEEFLNILFHHILRVEPLLKIRSAGQKVQDCYFYQIFMEKNEKVGVPTIQQLLEWSFINSNLKFAEAPSCLIIQMPRFGKDFKLFKKIFPSLELNITDLLEDTPRQCRICGGLAMYECRECYDDPDISAGKIKQFCKTCNTQVHLHPKRLNHKYNPVSLPKDLPDWDWRHGCIPCQNMELFAVLCIETSHYVAFVKYGKDDSAWLFFDSMADRDGGQNGFNIPQVTPCPEVGEYLKMSLEDLHSLDSRRIQGCARRLLCDAYMCMYQSPTMSLYK

SEQ ID NO: 642 - protein, 295 aa, Homo sapiens
MMAKKPPKPAPRRIFQERLKITALPLYFEGFLLIKRSGYREYEHYWTELRGTTLFFYTDKKSIIYVDKLDIVDLTCLTEQNSTEKNCAKFTLVLPKEEVQLKTENTESGEEWRGFILTVTELSVPQNVSLLPGQVIKLHEVLEREKKRRIETEQSTSVEKEKEPTEDYVDVLNPMPACFYTVSRKEATEMLQKNPSLGNMILRPGSDSRNYSITIRQEIDIPRIKHYKVMSVGQNYTIELEKPVTLPNLFSVIDYFVKETRGNLRPFICSTDENTGQEPSMEGRSEKLKKNPHIA

SEQ ID NO: 643 - protein, 249 aa, Homo sapiens
MAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 644 - protein, 368 aa, Homo sapiens
MFAKGKGSAVPSDGQAREKLALYVYEYLLHVGAQKSAQTFLSEIRWEKNITLGEPPGFLHSWWCVFWDLYCAAPERRDTCEHSSEAKAFHDYSAAAAPSPVLGNIPPNDGMPGGPIPPGFFQGPPGSQPSPHAQPPPHNPSSMMGPHSQPPGGVPGTQPLLPNSMDPTRQQGHPNMGGSMQRMNPPRGMGPMGPGPQNYGSGMRPPPNSLGPAMPGINMGPGAGRPWPNPNSANSIPYSSSSPGTYVGPPGGGGPPGTPIMPSPADSTNSSDNIYTMINPVPPGGSRSNFPMGPGSDGPMGGMGGMEPHHMNGSLGSGDIDGLPKNSPNNISGISNPPGTPRDDGELGGNFLHSFQNDNYSPSMTMSV

SEQ ID NO: 645 - protein, 189 aa, Homo sapiens [sequence omitted]

SEQ ID NO: 646 - protein, 824 aa, Homo sapiens
MAAAFEASGALAAVATAMPAEHVAVQVPAPEPTPGPVRILRTAQDLSSPRTRTGDVLLAEPADFESLLLSRPVLEGLRAAGFERPSPVQLKAIPLGRCGLDLIVQAKSGTGKTCVFSTIALDSLVLENLSTQILILAPTREIAVQIHSVITAIGIKMEGLECHVFIGGTPLSQDKTRLKKCHIAVGSPGRIKQLIELDYLNPGSIRLFILDEADKLLEEGSFQEQINWIYSSLPASKQMLAVSATYPEFLANALTKYMRDPTFVRLNSSDPSLIGLKQYYKVVNSYPLAHKVFEEKTQHLQELFSRIPFNQALVFSNLHSRAQHLADILSSKGFPAECISGNMNQNQRLDAMAKLKHFHCRVLISTDLTSRGIDAEKVNLVVNLDVPLDWETYMHRIGRAGRFGTLGLTVTYCCRGEEENMMMRIAQKCNINLLPLPDPIPSGLMEECVDWDVEVKAAVHTYGIASVPNQPLKKQIQKIERTLQIQKAHGDHMASSRNNSVSGLSVKSKNNTKQKLPVKSHSECGIIEKATSPKELGCDRQSEEQMKNSVQTPVENSTNSQHQVKEALPVSLPQIPCLSSFKIHQPYTLTFAELVEDYEHYIKEGLEKPVEIIRHYTGPGDQTVNPQNGFVRNKVIEQKVPVLASSSQSGDSESDSDSYSSRTSSQSKGNKSYLEGSSDNQLKDSESTPVDDRISLEQPPNGSDTPNPEKYQESPGIQMKTRLKEGASQRAKQSRRNLPRRSSFRLQTEAQEDDWYDCHREIRLSFSDTYQDYEEYWRAYYRAWQEYYAAASHSYYWNAQRHPSWMAAYHMNTIYLQEMMHSNQ

SEQ ID NO: 647 - protein, 321 aa, Homo sapiens
MLTLNKTDLIPASFILNGVPGLEDTQLWISFPFCSMYVVAMVGNCGLLYLIHYEDALHKPMYYFLAMLSFTDLVMCSSTIPKALCIFWFHLKDIGFDECLVQMFFTHTFTGMESGVLMLMALDRYVAICYPLRYSTILTNPVIAKVGTATFLRGVLLIIPFTFLTKLLPYCRGNILPHTYCDHMSVAKLSCGNVKVNAIYGLMVALLIWGFDILCITNSYTMILRAVVSLSSADARQKAFNTCTAHICAIVFSYTPAFFSFFSHRFGEHIIPPSCHIIVANIYLLLPPTMNPIVYGVKTKQIRDCVIRILSGSKDTKSYSM

SEQ ID NO: 648 - protein, 101 aa, Homo sapiens
MACPLEKALDVMVSTFHKYSGKEGDKFKLNKSELKELLTRELPSFLGKRTDEAAFQKLMSNLDSNRDNEVDFQEYCVFLSCIAMMCNEFFEGFPDKQPRKK

SEQ ID NO: 649 - protein, 110 aa, Homo sapiens
MSCQQNQQQCQPPPKCPPKCTPKCPPKCPPKCLPQCPAPCSPAVSSCCGPISGGCCGPSSGGCCNSGAGGCCLSHHRPRLFHRRRHQSPDCCESEPSGGSGCCHSSGGCC

SEQ ID NO: 650 - protein, 341 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 651 - protein, 146 aa, Homo sapiens; identical to SEQ ID NO: 508

SEQ ID NO: 652 - protein, 1621 aa, Homo sapiens
MEGCMGEESFQMWELNRRLEAYLARVKALEEQNELLSAELGGLRAQSADTSWRAHADDELAALRALVDQRWREKHAAEVARDNLAEELEGVAGRCQQLRLARERTTEEVARNRRAVEAEKCARAWLSSQVAELERELEALRVAHEEERVGLNAQAACAPRCPAPPRGPPAPAPEVEELARRLGEAWRGAVRGYQERVAHMETSLGQARERLGRAVQGAREGRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 653 - protein, 1042 aa, Homo sapiens
MELQKGKGAAAAAAASGAAGGGGGGAGAGAPGGGRLLLSTSLDAKDELEERLERCMSIVTSMTAGVSEREANDALNAYVCKGLPQHEEICLGLFTLILTEPAQAQKCYRDLALVSRDGMNIVLNKINQILMEKYLKLQDTCRTQLVWLVRELVKSGVLGADGVCMTFMKQIAGGDVTAKNIWLAESVLDILTEQREWVLKSSILIAMAVYTYLRLIVDHHGTAQLQALRQKEVDFCISLLRERFMECLMIGRDLVRLLQNVARIPEFELLWKDIIHNPQALSPQFTGILQLLQSRTSRKFLACRLTPDMETKLLFMTSRVRFGQQKRYQDWFQRQYLSTPDSQSLRCDLIRYICGVVHPSNEVLSSDILPRWAIIGWLLTTCTSNVAASNAKLALFYDWLFFSPDKDSIMNIEPAILVMHHSMKPHPAITATLLDFMCRIIPNFYPPLEGHVRQGVFSSLNHIVEKRVLAHLAPLFDNPKLDKELRAMLREKFPEFCSSPSPPVEVKIEEPVSMEMDNHMSDKDESCYDNAEAAFSDDEEDLNSKGKKREFRFHPIKETVVEEPVDITPYLDQLDESLRDKVLQLQKGSDTEAQCEVMQEIVDQVLEEDFDSEQLSVLASCLQELFKAHFRGEVLPEEITEESLEESVGKPLYLIFRNLCQMQEDNSSFSLLLDLLSELYQKQPKIGYHLLYYLRASKAAAGKMNLYESFAQATQLGDLHTCLMMDMKACQEDDVRLLCHLTPSIYTEFPDETLRSGELLNMIVAVIDSAQLQELVCHVMMGNLVMFRKDSVLNILIQSLDWETFEQYCAWQLFLAHNIPLETIIPILQHLKYKEHPEALSCLLLQLRREKPSEEMVKMVLSRPCHPDDQFTTSILRHWCMKHDELLAEHIKSLLIKNNSLPRKRQSLRSSSSKLAQLTLEQILEHLDNLRLNLTNTKQNFFSQTPILQALQHVQASCDEAHKMKFSDLFSLAEEYEDSSTKPPKSRRKAALSSPRSRKNATQPPNAEEESGSSSASEEEDTKPKPTKRKRKGSSAVGSDSD

SEQ ID NO: 654 - protein, 668 aa, Homo sapiens
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 655 - protein, 565 aa, Homo sapiens
MPQASEHRLGRTREPPVNIQPRVGSKLPFAPRARSKERRNPASGPNPMLRPLPPRPGLPDERLKKLELGRGRTSGPRPRGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRGRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 656 - protein, 333 aa, Homo sapiens
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHSSMNWIALVVIVPLVILIVLVLWFKKHCSYQDIL

SEQ ID NO: 657 - protein, 718 aa, Homo sapiens
MALYQRWRCLRLQGLQACRLHTAVVSTPPRWLAERLGLFEELWAAQVKRLASMAQKEPRTIKISLPGGQKIDAVAWNTTPYQLARQISSTLADTAVAAQVNGEPYDLERPLETDSDLRFLTFDSPEGKAVFWHSSTHVLGAAAEQFLGAVLCRGPSTEYGFYHDFFLGKERTIRGSELPVLERICQELTAAARPFRRLEASRDQLRQLFKDNPFKLHLIEEKVTGPTATVYGCGTLVDLCQGPHLRHTGQIGGLKLLSNSSSLWRSSGAPETLQRVSGISFPTTELLRVWEAWREEAELRDHRRIGKEQELFFFHELSPGSCFFLPRGTRVYNALVAFIRAEYAHRGFSEVKTPTLFSTKLWEQSGHWEHYQEDMFAVQPPGSDRPPSSQSDDSTRHITDTLALKPMNCPAHCLMFAHRPRSWRELPLRLADFGALHRAEASGGLGGLTRLRCFQQDDAHIFCTTDQLEAEIQSCLDFLRSVYAVLGFSFRLALSTRPSGFLGDPCLWDQAEQVLKQALKEFGEPWDLNSGDGAFYGPKIDVHLHDALGRPHQCGTIQLDFQLPLRFDLQYKGQAGALERPVLIHRAVLGSVERLLGVLAESCGGKWPLWLSPFQVVVIPVGSEQEEYAKEAQQSLRAAGLVSDLDADSGLTLSRRIRRAQLAHYNFQFVVGQKEQSKRTVNIRTRDNRRLGEWDLPEAVQRLVELQNTRVPNAEEIF

SEQ ID NO: 658 - protein, 97 aa, Homo sapiens
MCSSLEQALAVLVTTFHKYSCQEGDKFKLSKGEMKELLHKELPSFVGEKVDEEGLKKLMGSLDENSDQQVDFQEYAVFLALITVMCNDFFQGCPDRP

SEQ ID NO: 659 - protein, 491 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 660 - protein, 911 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGDCVPSPCHNGGTCLEEEEGVRCLCLPGYGGDLCDVGLRFCNPGWDAFQGACYKHFSTRRSWEEAETQCRMYGAHLASISTPEEQDFINNRYREYQWIGLNDRTIEGDFLWSDGVPLLYENWNPGQPDSYFLSGENCVVMVWHDQGQWSDVPCNYHLSYTCKMGLVSCGPPPELPLAQVFGRPRLRYEVDTVLRYRCREGLAQRNLPLIRCQENGRWEAPQISCVPRRPARALHPEEDPEGRQGRLLGRWKALLIPPSSPMPGP

SEQ ID NO: 661 - protein, 92 aa, Homo sapiens
MTKLAQWLWGLAILGSTWVALTTGALGLELPLSCQEVLWPLPAYLLVSAGCYALGTVGYRVATFHDCEDAARELQSQIQEARADLARRGLRF

SEQ ID NO: 662 - protein, 345 aa, Homo sapiens
MSSYQKELEKYRDIDEDEILRTLSPEELEQLDCELQEMDPENMLLPAGLRQRDQTKKSPTGPLDREALLQYLEQQALEVKERDDLVPFTGEKKGKPYIQPKREIPAEEQITLEPELEEALAHATDAEMCDIAAILDMYTLMSNKQYYDALCSGEICNTEGISSVVQPDKYKPVPDEPPNPTNIEEILKRVRSNDKELEEVNLNNIQDIPIPMLSELCEAMKANTYVRSFSLVATRSGDPIANAVADMLRENRSLQSLNIESNFISSTGLMAVLKAVRENATLIELRVDNQRQWPGDAVEMEMATVLEQCPSIVRFGYHFTQQGPRARAAQAMTRNNELRRQQKKR

SEQ ID NO: 663 - protein, 419 aa, Homo sapiens
MPLSRWLRSVGVFLLPAPYWAPRERWLGSLRRPSLVHGYPVLAWHSARCWCQAWTEEPRALCSSLRMNGDQNSDVYAQEKQDFVQHFSQIVRVLTEDEMGHPEIGDAIARLKEVLEYNAIGGKYNRGLTVVVAFRELVEPRKQDADSLQRAWTVGWCVELLQAFFLVADDIMDSSLTRRGQICWYQKPGVGLDAINDANLLEACIYRLLKLYCREQPYYLNLIELFLQSSYQTEIGQTLDLLTAPQGNVDLVRFTEKRYKSIVKYKTAFYSFYLPIAAAMYMAGIDGEKEHANAKKILLEMGEFFQIQDDYLDLFGDPSVTGKIGTDIQDNKCSWLVVQCLQRATPEQYQILKENYGQKEAEKVARVKALYEELDLPAVFLQYEEDSYSHIMALIEQYAAPLPPAVFLGLARKIYKRRK

SEQ ID NO: 664 - protein, 376 aa, Homo sapiens [sequence omitted]

SEQ ID NO: 665 - protein, 90 aa, Homo sapiens
MRDPVSSQYSSFLFWRMPIPELDLSELEGLGLSDTATYKVKDSSVGKMIGQATAADQEKNPEGDGLLEYSTFNFWRAPIASIHSFELDLL

SEQ ID NO: 666 - protein, 789 aa, Homo sapiens
MAATTANPEMTSDVPSLGPAIASGNSGPGIQGGGAIVQRAIKRRPGLDFDDDGEGNSKFLRCDDDQMSNDKERFARSDDEQSSADKERLARENHSEIERRRRNKMTAYITELSDMVPTCSALARKPDKLTILRMAVSHMKSLRGTGNTSTDGSYKPSFLTDQELKHLILEAADGFLFIVSCETGRVVYVSDSVTPVLNQPQSEWFGSTLYDQVHPDDVDKLREQLSTSENALTGRILDLKTGTVKKEGQQSSMRMCMGSRRSFICRMRCGSSSVDPVSVNRLSFVRNRCRNGLGSVKDGEPHFVVVHCTGYIKAWPPAGVSLPDDDPEAGQGSKFCLVAIGRLQVTSSPNCTDMSNVCQPTEFISRHNIEGIFTFVDHRCVATVGYQPQELLGKNIVEFCHPEDQQLLRDSFQQVVKLKGQVLSVMFRFRSKNQEWLWMRTSSFTFQNPYSDEIEYIICTNTNVKNSSQEPRPTLSNTIQRPQLGPTANLPLEMGSGQLAPRQQQQQTELDMVPGRDGLASYNHSQVVQPVTTTGPEHSKPLEKSDGLFAQDRDPRFSEIYHNINADQSKGISSSTVPATQQLFSQGNTFPPTPRPAENFRNSGLAPPVTIVQPSASAGQMLAQISRHSNPTQGATPTWTPTTRSGFSAQQVATQATAKTRTSQFGVGSFQTPSSFSSMSLPGAPTASPGAAAYPSLTNRGSNFAPETGQTAGQFQTRTAEGVGVWPQWQGQQPHHRSSSSEQHVQQPPAQQPGQPEVFQEMLSMLGDQSNSYNNEEFPDLTMFPPFSE

SEQ ID NO: 667 - protein, 1087 aa, Homo sapiens; identical to SEQ ID NO: 365

SEQ ID NO: 668 - protein, 736 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 669 - protein, 474 aa, Homo sapiens; identical to SEQ ID NO: 471

SEQ ID NO: 670 - protein, 394 aa, Homo sapiens
MTEQETLALLEVKRSDSPEKSSPQALVPNGRQPEGEGGAESPGAESLRVGSSAGSPTAIEGAEDGLDSTVSEAATLPWGTGPQPSAPFPDPPGWRDIEPEPPESEPLTKLEELPEDDANLLPEKAARAFVPIDLQCIERQPQEDLIVRCEAGEGECRTFMPPRVTHPDPTERKWAEAVVRPPGCSCGGCGSCGDREWLRAVASVGAALILFPCLLYGAYAFLPFDVPRLPTMSSRLIYTLRCGVFATFPIVLGILVYGLSLLCFSALRPFGEPRREVEIHRRYVAQSVQLFILYFFNLAVLSTYLPQDTLKLLPLLTGLFAVSRLIYWLTFAVGRSFRGFGYGLTFLPLLSMLMWNLYYMFVVEPERMLTATESRLDYPDHARSASDYRPRPWG

SEQ ID NO: 671 - protein, 570 aa, Homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLMQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 672 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 673 - protein, 395 aa, Homo sapiens
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 674 - protein, 977 aa, Homo sapiens
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPHSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEDAALERRSANSAGGVAISFSLTAEHSGNYYCTADNGFGPQRSKAVSLSITVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGPEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPPDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 675 - protein, 162 aa, Homo sapiens
MRIANRTRFSSPFLARGAGWTHGRGMMVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 676 - protein, 619 aa, Homo sapiens; identical to SEQ ID NO: 540

SEQ ID NO: 677 - protein, 240 aa, Homo sapiens
MSRSNRQKEYKCGDLVFAKMKGYPHWPARIDEMPEAAVKSTANKYQVFFFGTHETAFLGPKDLFPYEESKEKFGKPNKRKGFSEGLWEIENNPTVKASGYQSSQKKSCVEEPEPEPEAAEGDGDKKGNAEGSSDEEGKLVIDEPAKEKNEKGALKRRAGDLLEDSPKRPKEAENPEGEEKEAATLEVERPLPMEVEKNSTPSEPGSGRGPPQEEEEEEDEEEEATKEDAEAPGIRDHESL

SEQ ID NO: 678 - protein, 275 aa, Homo sapiens
MRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 679 - protein, 90 aa, Homo sapiens
MACPLDQAIGLLVAIFHKYSGREGDKHTLSKKELKELIQKELTIGSKLQDAEIARLMEDLDRNKDQEVNFQEYVTFLGALALIYNEALKG

SEQ ID NO: 680 - protein, 1224 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKVSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 681 - protein, 324 aa, Homo sapiens
MGPWGEPELLVWRPEAVASEPPVPVGLEVKLGALVLLLVLTLLCSLVPICVLRRPGANHEGSASRQKALSLVSCFAGGVFLATCLLDLLPDYLAAIDEALAALHVTLQFPLQEFILAMGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFLYITFLEILPQELASSEQRILKVILLLAGFALLTGLLFIQI

SEQ ID NO: 682 - protein, 455 aa, Homo sapiens
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 683 - protein, 125 aa, Homo sapiens; identical to SEQ ID NO: 487

SEQ ID NO: 684 - protein, 570 aa, Homo sapiens
MNVVFAVKQYISKMIEDSGPGMKVLLMDKETTGIVSMVYTQSEILQKEVYLFERIDSQNREIMKHLKAICFLRPTKENVDYIIQELRRPKYTIYFIYFSNVISKSDVKSLAEADEQEVVAEVQEFYGDYIAVNPHLFSLNILGCCQGRNWDPAQLSRTTQGLTALLLSLKKCPMIRYQLSSEAAKRLAECVKQVITKEYELFEFRRTEVPPLLLILDRCDDAITPLLNQWTYQAMVHELLGINNNRIDLSRVPGISKDLREVVLSAENDEFYANNMYLNFAEIGSNIKNLMEDFQKKKPKEQQKLESIADMKAFVENYPQFKKMSGTVSKHVTVVGELSRLVSERNLLEVSEVEQELACQNDHSSALQNIKRLLQNPKVTEFDAARLVMLYALHYERHSSNSLPGLMMDLRNKGVSEKYRKLVSAVVEYGGKRVRGSDLFSPKDAVAITKQFLKGLKGVENVYTQHQPFLHETLDHLIKGRLKENLYPYLGPSTLRDRPQDIIVFVIGGATYEEALTVYNLNRTTPGVRIVLGGTTVHNTKSFLEEVLASGLHSRSKESSQVTSRSASRR

SEQ ID NO: 685 - protein, 468 aa, Homo sapiens; identical to SEQ ID NO: 447

SEQ ID NO: 686 - protein, 536 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWHRQ

SEQ ID NO: 687 - protein, 406 aa, Homo sapiens; identical to SEQ ID NO: 556

SEQ ID NO: 688 - protein, 655 aa, Homo sapiens
MAEAPQVVEIDPDFEPLPRPRSCTWPLPRPEFSQSNSATSSPAPSGSAAANPDAAAGLPSASAAAVSADFMSNLSLLEESEDFPQAPGSVAAAVAAAAAAAATGGLCGDFQGPEAGCLHPAPPQPPPPGPLSQHPPVPPAAAGPLAGQPRKSSSSRRNAWGNLSYADLITKAIESSAEKRLTLSQIYEWMVKSVPYFKDKGDSNSSAGWKNSIRHNLSLHSKFIRVQNEGTGKSSWWMLNPEGGKSGKSPRRRAASMDNNSKFAKSRSRAAKKKASLQSGQEGAGDSPGSQFSKWPASPGSHSNDDFDNWSTFRPRTSSNASTISGRLSPIMTEQDDLGEGDVHSMVYPPSAAKMASTLPSLSEISNPENMENLLDNLNLLSSPTSLTVSTQSSPGTMMQQTPCYSFAPPNTSLNSPSPNYQKYTYGQSSMSPLPQMPIQTLQDNKSSYGGMSQYNCAPGLLKELLTSDSPPHNDIMTPVDPGVAQPNSRVLGQNVMMGPNSVMSTYGSQASHNKMMNPSSHTHPGHAQQTSAVNGRPLPHTVSTMPHTSGMNRLTQVKTPVQVPLPHPMQMSALGGYSSVSSCNGYGRMGLLHQEKLPSDLDGMFIERLDCDMESIIRNDLMDGDTLDFNFDNVLPNQSFPHSVKTTTHSWVSG

SEQ ID NO: 689 - protein, 517 aa, Homo sapiens
MQKPPLLLRRPLPPKFTKLSLHEKKTHTAKTGKIESLHVAFTEDETTSIKMDRTRFPDVLRNQSLTPINIQNIFLDHCVQERVTAISSPQKSTKHVREQIPDTATGSIFFPHCNSASTRIFGKQTNKMESSRKFKTMKDVYTEKRLENILILSSKFSKPKSTPGSVIAQKLEKMHPKHQPLPESPGYTYQHISRDLSATVPSPPPMTVSMKPEGQWPEHFKSTATLTLRVTEFPGFVSLPTPVLPRKPHRQSVIETLVTENGNIESVPKQIPPRPPEGLTKTEKIESEIHVVRGEGFKTVAATRYETITAMTNLAIVNCQVYGRNALNLKGFFILNCPDLTPLAFQLIYLNLSFNDLHYFPTEILCLKNLQILKLRNNPIKEIPSEIQQLEFLRIFTIAFNLITVLPIGLFSLSYLEELDVSYNELTFIPNEIQKLRSLEKLTVDGNELSFFPHGILKLNLTKIQFENNFTHPCFWRDNYLNNPQQLTQIISLFIVQNKLHKFYDKIPVEVQKLLKW

SEQ ID NO: 690 - protein, 1901 aa, Homo sapiens
MATFRNNHMKTKASVRKSFSEDVFQSVKSLLQSQKELCSVTAEDCLQQDEHANLTEVTFLGFNEETDAAHIQDLAAVSLELPDILNSLHFCSLNENEIICMKNINKPLDISSDPLNQSHPSGMLCVMRVSPTSPRLRIDFIFSLLSKYATGIRYTLDTFLHQKHQLETTDEDDDDTNQSVSSIEDDFVTAFEHLEEEETSKPYNDGMNITVLRSQCDAASQTVTGHHLETHDLKILISSGQQKSLAKPSTSSVNVLGHKELPSVKTSVTTSISEPWTQRSFYRSSNASDKDSDLQKTFFSSSPAYSSESECSSPSPVIFLDEEGYQKSLKAKLELPKIPVMKDDIEDSDSEVSEFFDSFDQFDELEQTLETCLFNKDPVIGKSSQRKGHKHGKSCMNPQKFKFDRPALPANVRKPTPRKPESPYGNLCDAPDSPRPVKASREDSGLFSPIRSSAFSPLGGCTPAECFCQTDIGGDRIHENHDSVYYTYEDYAKSISCEVLGSVLRTHHTNTLSNINSIKHGENKTVTFKHGNLDQKNKSKNKSLMIKDSIQKFAADLVEKSFGSAFKDLQKGVSSCTNALYHLAIKLTSSVLQMAFDELRRQRAFSLKERAISGLANFLVSEALSNALKDLQYVKKQIFTNTVARFAADLAEELVFEGIMEVCQFSYPQTPASPQCGSFDFEDKVVKLYAKDLSESVIQEAFIELSQVDVTFTTKAAVSVSTDNIKYVSAESVVPSTQAVTFSPSFHNQAIMVTKPVQEYKKEYTVQQALFCTSGIVTSIPVPLAGSALLPYHISSTACQAKAHLSSDDSNSNGDSAQVHIATKNREEKAACLRNICLPSEHNPGNQNDFKPTNDDIEMQSSSKLPNDPAIISNFSAAVVHTIVNETLESMTSLEVTKMVDERTDYLTKSLKEKTPPFSHCDQAVLQCSEASSNKDMFADRLSKSIIKHSIDKSKSVIPNIDKNAVYKESLPVSGEESQLTPEKSPKFPDSQNQLTHCSLSAAKDCVPECKVSMVHGSSLETLPSCPAVTGQKSDLKESAKDQPLKKHNLNSTSLEALSFGQENPFPHSHTFSSTALTCVDGLHVEDKQKVRDRNVIPDTPPSTPLVPSRASSEWDIKKLTKKLKGELAKEFAPATPPSTPHNSSVGSLSENEQNTIEKEEFMLKLMRSLSEEVESSESGELPEVDVKSEHSGKKVQFAEALATHILSLATEMAASHLDNKIIQEPKVKNPCLNVQSQRSVSPTFLNPSDENLKTLCNFAGDLAAEVITEAEKIAKVRNCMLFKQKKNSCYADGDEDYKVEEKLDIEAVVHPREVDPFILSLPPSSCMSGLMYKYPSCESVTDEYAGHLIQILKQEGGNSELIMDQYANRLAYRSVKSGLQEAAKTTKVQCNSRMFPVPSSQVKTNKELLMFSNKEHHQEADKKRQSKRNEGYFCKNQTCERTLDPYRNEVSQLYSFSTSLVHSITKDAKEELTASLVGLPKSLTDSCLFEKSGYEEDNECHVTPELPKSLQPSSQNHRFYHSTGSLNGYGCGDNVVQAVEQYAKKVVDDTLELTLGSTVFRVSETTKSADRVTYAEKLSPLTGQACRYCDLKELHNCTGNSSQHFFRQGSLASSKPASNPKFSSRYQKSRIFHLSVPQIHVNLDKKAVLAEKIVAEAIEKAERELSSTSLAADSGIGQEGASFAESLATETMTAAVTNVGHAVSSSKEIEDFQSTESVSSQQMNLSIGDDSTGSWSNLSFEDEHQDESSSFHHLSESNGNSSSWSSLGLEGDLYEDNLSFPTSDSDGPDDKDEEHEDEVEGLGQDGKTLLITNIDMEPCTVDPQLRIILQWLIASEAEVAELYFHDSANKEFMLLSKQLQEKGWKVGDLLQAVLQYYEVMEKASSEERCKSLFDWLLENA

SEQ ID NO: 691 - protein, 376 aa, Homo sapiens
MADYWKSQPKKFCDYCKCWIADNRPSVEFHERGKNHKENVAKRISEIKQKSLDKAKEEEKASKEFAAMEAAALKAYQEDLKRLGLESEILEPSITPVTSTIPPTSTSNQQKEKKEKKKRKKDPSKGRWVEGITSEGYHYYYDLISGASQWEKPEGFQGDLKKTAVKTVWVEGLSEDGFTYYYNTETGESRWEKPDDFIPHTSDLPSSKVNENSLGTLDESKSSDSHSDSDGEQEAEEGGVSTETEKPKIKFKEKNKNSDGGSDPETQKEKSIQKQNSLGSNEEKSKTLKKSNPYGEWQEIKQEVESHEEVDLELPSTENEYVSTSEADGGGEPKVVFKEKTVTSLGVMADGVAPVFKKRRTENGKSRNLRQRGDDQ

SEQ ID NO: 692 - protein, 407 aa, Homo sapiens
MELLEEDLTCPICCSLFDDPRVLPCSHNFCKKCLEGILEGSVRNSLWRPAPFKCPTCRKETSATGINSLQVNYSLKGIVEKYNKIKISPKMPVCKGHLGQPLNIFCLTDMQLICGICATRGEHTKHVFCSIEDAYAQERDAFESLFQSFETWRRGDALSRLDTLETSKRKSLQLLTKDSDKVKEFFEKLQHTLDQKKNEILSDFETMKLAVMQAYDPEINKLNTILQEQRMAFNIAEAFKDVSEPIVFLQQMQEFREKIKVIKETPLPPSNLPASPLMKNFDTSQWEDIKLVDVDKLSLPQDTGTFISKIPWSFYKLFLLILLLGLVIVFGPTMFLEWSLFDDLATWKGCLSNFSSYLTKTADFIEQSVFYWEQVTDGFFIFNERFKNFTLVVLNNVAEFVCKYKLL

SEQ ID NO: 693 - protein, 307 aa, Homo sapiens
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 694 - protein, 249 aa, Homo sapiens
MAERGELDLTGAKQNTGVWLVKVPKYLSQQWAKASGRGEVGKLRIAKTQGRTEVSFTLNEDLANIHDIGGKPASVSAPREHPFVLQSVGGQTLTVFTESSSDKLSLEGIVVQRAECRPAASENYMRLKRLQIEESSKPVRLSQQLDKVVTTNYKPVANHQYNIEYERKKKEDGKRARADKQHVLDMLFSAFEKHQYYNLKDLVDITKQPVVYLKEILKEIGVQNVKGIHKNTWELKPEYRHYQGEEKSD

SEQ ID NO: 695 - protein, 291 aa, Homo sapiens
MSALNWKPFVYGGLASITAECGTFPIDLTKTRLQIQGQTNDAKFKEIRYRGMLHALVRIGREEGLKALYSGIAPAMLRQASYGTIKIGTYQSLKRLFIERPEDETLPINVICGILSGVISSTIANPTDVLKIRMQAQSNTIQGGMIGNFMNIYQQEGTRGLWKGVSLTAQRAAIVVGVELPVYDITKKHLILSGLMGDTVYTHFLSSFTCGLAGALASNPVDVVRTRMMNQRVLRDGRCSGYTGTLDCLLQTWKNEGFFALYKGFWPNWLRLGPWNIIFFVTYEQLKKLDL

SEQ ID NO: 696 - protein, 810 aa, Homo sapiens
MISSCGTIPGNPYPKGRPSRINGIFPGTPLKKDGEECTNEGKGIAARILGPSKPPPSTYNPHKPVPYPIPPCRPHATIAPSAYNNAGLVPLANVIAPPPPPYTPNPVGTENEDLSNPSKPIQNQTFSTPASQLFSPHGSNPSTPAATPVPTASPVKAINHPSASAAATVSGMNLLNTVLPVFPGQVSSAVHTPQPSIPNPTVIRTPSLPTAPVTSIHSTTTTPVPSIFSGLVSLPGPSATPTAATPTPGPTPRSTLGSSEAFASTSAPFTSLPFSTSSSAASTSNPNSASLSSVFAGLPLPLPPTSQGLSNPTPVIAGGSTPSVAGPLGVNSPLLSALKGFLTSNDTNLINSSALSSAVTSGLASLSSLTLQNSDSSASAPNKCYAPSAIPTPQRTSTPGLALFPGLPSPVANSTSTPLTLPVQSPLATAASASTSVPVSCGSSASLLRGPHPGTSDLHISSTPAATTLPVMIKTEPTSPTPSAFKGPSHSGNPSHGTLGLSGTLGRAYTSTSVPISLSACLNPALSGLSSLSTPLNGSNPLSSISLPPHGSSTPIAPVFTALPSFTSLTNNFPLTGNPSLNPSVSLPGSLIATSSTAATSTSLPHPSSTAAVLSGLSASAPVSAAPFPLNLSTAVPSLFSVTQGPLSSSNPSYPGFSVSNTPSVTPALPSFPGLQAPSTVAAVTPLPVAATAPSPAPVLPGFASAFSSNFNSALVAQAGLSSGLQAAGSSVFPGLLSLPGIPGFPQNPSQSSLQELQHNAAAQSALLQQVHSASALESYPAQPDGFPSYPSAPGTPFSLQPSLSQSGWQ

SEQ ID NO: 697 - protein, 728 aa, Homo sapiens
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLPLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 698 - protein, 344 aa, Homo sapiens
MVSVNSSHCFYNDSFKYTLYGCMFSMVFVLGLISNCVAIYIFICVLKVRNETTTYMINLAMSDLLFVFTLPFRIFYFTTRNWPFGDLLCKISVMLFYTNMYGSILFLTCISVDRFLAIVYPFKSKTLRTKRNAKIVCTGVWLTVIGGSAPAVFVQSTHSQGNNASEACFENFPEATWKTYLSRIVIFIEIVGFFIPLILNVTCSSMVLKTLTKPVTLSRSKINKTKVLKMIFVHLIIFCFCFVPYNINLILYSLVRTQTFVNCSVVAAVRTMYPITLCIAVSNCCFDPIVYYFTSDTIQNSIKMKNWSVRRSDFRFSEVHGAENFIQHNLQTLKSKIFDNESAA

SEQ ID NO: 699 - protein, 551 aa, Homo sapiens
MEEELPLFSGDSGKPVQATLSSLKMLDVGKWPIFSLCSEEELQLIRQACVFGSAGNEVLYTTVNDEIFVLGTNCCGCLGLGDVQSTIEPRRLDSLNGKKIACLSYGSGPHIVLATTEGEVFTWGHNAYSQLGNGTTNHGLVPCHISTNLSNKQVIEVACGSYHSLVLTSDGEVFAWGYNNSGQVGSGSTVNQPIPRRVTGCLQNKVVVTIACGQMCCMAVVDTGEVYVWGYNGNGQLGLGNSGNQPTPCRVAALQGIRVQRVACGYAHTLVLTDEGQVYAWGANSYGQLGTGNKSNQSYPTPVTVEKDRIIEIAACHSTHTSAAKTQGGHVYMWGQCRGQSVILPHLTHFSCTDDVFACFATPAVTWRLLSVEPDDHLTVAESLKREFDNPDTADLKFLVDGKYIYAHKVLLKIRCEHFRSSLEDNEDDIVEMSEFSYPVYRAFLEYLYTDSISLSPEEAVGLLDLATFYRENRLKKLCQQTIKQGICEENAIALLSAAVKYDAQDLEEFCFRFCINHLTVVTQTSGFAEMDHDLLKNFISKASRVGAFKN

SEQ ID NO: 700 - protein, 196 aa, Homo sapiens
MGSVNSRGHKAEAQVVMMGLDSAGKTTLLYKLKGHQLVETLPTVGFNVEPLKAPGHVSLTLWDVGGQAPLRASWKDYLEGTDILVYVLDSTDEARLPESAAELTEVLNDPNMAGVPFLVLANKQEAPDALPLLKIRNRLSLERFQDHCWELRGCSALTGEGLPEALQSLWSLLKSRSCMCLQARAHGAERGDSKRS

SEQ ID NO: 701 - protein, 340 aa, Homo sapiens
MARDLIGPALPPGFKARGTAEDEERDPSPVAGPALPPNYKSSSSDSSDSDEDSSSLYEEGNQESEEDDSGPTARKQRKNQDDDDDDDDGFFGPALPPGFKKQDDSPPRPIIGPALPPGFIKSTQKSDKGRDDPGQQETDSSEDEDIIGPMPAKGPVNYNVTTEFEKRAQRMKEKLTKGDDDSSKPIVRESWMTELPPEMKDFGLGPRTFKRRADDTSGDRSIWTDTPADRERKAKETQEARKSSSKKDEEHILSGRDKRLAEQVSSYNESKRSESLMDIHHKKLKSKAAEDKNKPQERIPFDRDKDLKVNRFDEAQKKALIKKSRELNTRFSHGKGNMFL

SEQ ID NO: 702 - protein, 150 aa, Homo sapiens
MAARGVIAPVGESLRYAEYLQPSAKRPDADVDQQGLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 703 - protein, 164 aa, Homo sapiens [sequence omitted]

SEQ ID NO: 704 - protein, 395 aa, Homo sapiens
MFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWNVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 705 - DNA, 4878 bp, Homo sapiens
tcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccaaaaa

SEQ ID NO: 706 - protein, 587 aa, Homo sapiens
MSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 707 - DNA, 3257 bp, Homo sapiens
ggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccctaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttaaaaaaaaaaaaaaaaaaaaaaaaaaaa

SEQ ID NO: 708 - protein, 761 aa, Homo sapiens
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRPGSCSVGPSSDKALTFMKDHFLMDEQVVGTPLLVKSGVEYTRLAVETAQGLDGHSHLVMYLGTTTGSLHKAVVSGDSSAHLVEEIQLFPDPEPVRNLQLAPTQGAVFVGFSGGVWRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 709 - DNA, 3600 bp, Homo sapiens
cacgaggggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagagagagctgtagtacacatggatgaacgacgagaagaacaaattgtacagttactgaattctgttcaagcgaagaatgataaagagtcagaagcacagatatcctggtttgctcctgaggatcatggatacggtactgaagtttctactaagaacacaccatgctcagagaacaaacttgacatccaggaaaagaagttgataaatcaagaaaaaaaaatgtttagaatcaggaacagatcatatattgaccgagattctgagtatctcttgcaagaaaatgaaccagatggaactttagaccaaaaattattggaagatttacaaaagaaaaaaaatgaccttcggtatattgaaatgcagcatttcagagaaaagctgccttcgtatggaatgcaaaaggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagttgcggaaagagtagctgcagaaagggcagaatcttgtggcagtggtaatagtactggatatcaaattcgtctccagagtcggttgccaaggaaacagggttctatcttatactgtacaacaggaatcatccttcagtggctccagtcagacccgtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtaactgtccaatgatacatatacctggttttacctttccggttgtggaatatcttttggaagatgtaattgaaaaaataaggtatgttccagaacaaaaagaacacagatgccagtttaagaggggtttcatgcaagggcatgtaaatagacaagaaaaagaagaaaaagaagcaatatataaagaacgttggccagattatgtaagggaactgcgaagaaggtattctgcaagtactgtagatgttatagaaatgatggaggatgataaagttgatctgaatttgattgttgccctcatccgatacattgttttggaagaagaggatggtgcgatactggtctttctgccaggctgggacaatatcagcactttacatgatctcttgatgtcacaagtaatgtttaaatcagataaatttttaattatacctttacattcactgatgcctacagttaaccagacacaggtgtttaaaagaacccctcctggtgttcggaaaatagtaattgctaccaacattgcggagactagcattaccatagatgatgtcgtttatgtgatagatggaggaaaaataaaagagacgcattttgatactcagaacaatatcagtacaatgtccgctgagtgggttagtaaagctaatgccaaacagagaaaaggtcgagctggaagagttcaacctggtcattgctatcatctgtataatggtcttagagcaagtcttctagatgactatcaactgccagaaattttgagaactcctttggaagaactttgtttacaaataaagattttaaggctaggtggaattgcttattttctgagtagattaatggacccaccatcaaatgaggcagtgttactctccataagacacctgatggagctgaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactgggaaaagaaaagattgcagatgcaagaagaaaggaattggcaaaggatactagaagtgatcacttaacagttgtgaatgcgtttgagggctgggaagaggctaggcgacgtggtttcagatacgaaaaggactattgctgggaatattttctgtcttcaaacacactgcagatgctgcataacatgaaaggacagtttgctgagcatcttcttggagctggatttgtaagcagtagaaatcctaaagatccagaatctaatataaattcagataatgagaagataattaaagctgtcatctgtgctggtttatatcccaaagttgctaaaattcgactaaatttgggtaaaaaaagaaaaatggtaaaagtttacacaaaaaccgatggcctggttgctgttcatcctaaatctgttaatgtggagcaaacagactttcactacaactggcttatctatcacctaaagatgagaacaagcagtatatacttgtatgactgcacagaggtttccccatactgtctcttgttttttggaggtgacatttccatccagaaggataacgatcaggaaactattgctgtagatgagtggattgtatttcagtctccagcaagaattgcccatcttgttaaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacacaaccacattttttaaaatgaaacttctatcggaagtaaattaatttgttgtaataaagtccagtatttaataaaatgtacaatgttaaatctc

SEQ ID NO: 710 - protein, 1008 aa, Homo sapiens
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRCQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 711 - DNA, 1928 bp, Homo sapiens
ggcgtcgggctggagagccgcagtcccggctgcagcacctgggagaaggcagaccgtgtgagggggcctgtggccccagcgtgctgtggcctccgggagtgggaagtggaggcaggagccttccttacacttcgccatgagtttcctgatcgactccagcatcatgattacctcccagatactattttttggatttgggtggcttttcttcatgcgccaattgtttaaagactatgagatacgtcagtatgttgtacaggtgatcttctccgtgacgtttgcattttcttgcaccatgtttgagctcatcatctttgaaatcttaggagtattgaatagcagctcccgttattttcactggaaaatgaacctgtgtgtaattctgctgatcctggttttcatggtgcctttttacattggctattttattgtgagcaatatccgactactgcataaacaacgactgcttttttcctgtctcttatggctgacctttatgtatttcttctggaaactaggagatccctttcccattctcagcccaaaacatgggatcttatccatagaacagctcatcagccgggttggtgtgattggagtgactctcatggctcttctttctggatttggtgctgtcaactgcccatacacttacatgtcttacttcctcaggaatgtgactgacacggatattctagccctggaacggcgactgctgcaaaccatggatatgatcataagcaaaaagaaaaggatggcaatggcacggagaacaatgttccagaagggggaagtgcataacaaaccatcaggtttctggggaatgataaaaagtgttaccacttcagcatcaggaagtgaaaatcttactcttattcaacaggaagtggatgctttggaagaattaagcaggcagctttttctggaaacagctgatctatatgctaccaaggagagaatagaatactccaaaaccttcaaggggaaatattttaattttcttggttactttttctctatttactgtgtttggaaaattttcatggctaccatcaatattgtttttgatcgagttgggaaaacggatcctgtcacaagaggcattgagatcactgtgaattatctgggaatccaatttgatgtgaagttttggtcccaacacatttccttcattcttgttggaataatcatcgtcacatccatcagaggattgctgatcactcttaccaagttcttttatgccatctctagcagtaagtcctccaatgtcattgtcctgctattagcacagataatgggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaaca

SEQ ID NO: 712 - protein, 455 aa, Homo sapiens; identical to SEQ ID NO: 682

SEQ ID NO: 713 - protein, 4 aa, Artificial Sequence
  Description of Artificial Sequence: Synthetic peptide
DEAD

What is claimed is:

1. A method of assessing whether a subject is afflicted with multiple myeloma, the method comprising:
   a) determining the amount of a marker in a subject sample comprising plasma cells, wherein the marker is PRKCi;
   b) determining a normal amount of the marker in a non-multiple myeloma control sample comprising plasma cells; and
   c) comparing the amount of the marker in the subject sample and the normal amount of the marker in the non-multiple myeloma control sample,
   wherein a significant increase in the amount of the marker in the subject sample relative to the normal amount of the marker in the non-multiple myeloma control sample is an indication that the subject is afflicted with multiple myeloma.

2. A method of assessing whether a subject is afflicted with multiple myeloma, the method comprising:
   a) determining the amount of a marker in a subject sample comprising plasma cells, wherein the marker is SEMA4A;
   b) determining a normal amount of the marker in a non-multiple myeloma control sample comprising plasma cells; and
   c) comparing the amount of the marker in the subject sample and the normal amount of the marker in the non-multiple myeloma control sample, wherein a significant increase in the amount of the marker in the subject sample relative to the normal amount of the marker in the non-multiple myeloma control sample is an indication that the subject is afflicted with multiple myeloma.

3. A method of assessing whether a subject is afflicted with multiple myeloma, the method comprising:
   a) determining the amount of a marker in a subject sample comprising plasma cells, wherein the marker is DHX36; and
   b) determining a normal amount of the marker in a non-multiple myeloma control sample comprising plasma cells; and
   c) comparing the amount of the marker in the subject sample and the normal amount of the marker in the non-multiple myeloma control sample,
   wherein a significant increase in the amount of the marker in the subject sample relative to the normal amount of the marker in the non-multiple myeloma control sample is an indication that the subject is afflicted with multiple myeloma.

4. The method of claim 1, 2, or 3, wherein the amount of the marker is determined by determining the level of expression of the marker.

5. The method of claim 1, 2, or 3, wherein the amount of the marker is determined by determining copy number of the marker.

6. The method of claim 1, 2, or 3, wherein the subject and control sample is selected from the group consisting of tissue, whole blood, serum, plasma, buccal scrape, saliva, cerebrospinal fluid, urine, stool, and bone marrow.

7. The method of claim 5, wherein the copy number is assessed by comparative genomic hybridization (CGH).

8. The method of claim 7, wherein said CGH is performed on an array.

9. The method of claim 1, 2, or 3, wherein the level of expression of the marker in the subject or control sample is assessed by detecting the presence in the subject or control sample of a protein corresponding to the marker.

10. The method of claim 9, wherein the presence of the protein is detected using a reagent which specifically binds with the protein.

11. The method of claim 10, wherein the reagent is selected from the group consisting of an antibody, an antibody derivative, and an antibody fragment.

12. The method of claim 1, 2, or 3, wherein the level of expression of the marker in the sample is assessed by detecting the presence in the sample of a transcribed polynucleotide or portion thereof, wherein the transcribed polynucleotide comprises the marker.

13. The method of claim 12, wherein the transcribed polynucleotide is an mRNA.

14. The method of claim 12, wherein the transcribed polynucleotide is a cDNA.

15. The method of claim 12, wherein the step of detecting further comprises amplifying the transcribed polynucleotide.

16. The method of claim 1, 2, or 3, wherein the level of expression of the marker in the subject or control sample is assessed by detecting the presence in the subject or control sample of a transcribed polynucleotide which anneals with the marker or anneals with a portion of a polynucleotide wherein the polynucleotide comprises the marker, under stringent hybridization conditions.

* * * * *